US011504404B2

(12) United States Patent
Hitchcock et al.

(10) Patent No.: US 11,504,404 B2
(45) Date of Patent: *Nov. 22, 2022

(54) SKIN PROBIOTIC FORMULATION

(71) Applicant: CROWN LABORATORIES, INC., Johnson City, TN (US)

(72) Inventors: Thomas Hitchcock, San Diego, CA (US); Mun Su Rhee, San Diego, CA (US)

(73) Assignee: CROWN LABORATORIES, INC., Johnson City, TN (US)

( * ) Notice: Subject to any disclaimer, the term of this patent is extended or adjusted under 35 U.S.C. 154(b) by 1119 days.

This patent is subject to a terminal disclaimer.

(21) Appl. No.: 16/079,876

(22) PCT Filed: Feb. 24, 2017

(86) PCT No.: PCT/US2017/019476
§ 371 (c)(1),
(2) Date: Aug. 24, 2018

(87) PCT Pub. No.: WO2017/147507
PCT Pub. Date: Aug. 31, 2017

(65) Prior Publication Data
US 2019/0060374 A1    Feb. 28, 2019

Related U.S. Application Data

(60) Provisional application No. 62/299,237, filed on Feb. 24, 2016.

(51) Int. Cl.
| C12N 1/20 | (2006.01) |
| C12N 15/74 | (2006.01) |
| C12N 15/87 | (2006.01) |
| A61K 9/00 | (2006.01) |
| A61K 9/06 | (2006.01) |
| A61K 35/74 | (2015.01) |
| A61K 48/00 | (2006.01) |
| C07K 14/475 | (2006.01) |
| C07K 14/52 | (2006.01) |
| A61K 35/741 | (2015.01) |
| C07K 14/715 | (2006.01) |
| A61K 38/20 | (2006.01) |
| C07K 14/485 | (2006.01) |
| C07K 14/54 | (2006.01) |
| C07K 14/61 | (2006.01) |
| C12R 1/01 | (2006.01) |
| A61K 35/00 | (2006.01) |

(52) U.S. Cl.
CPC .......... *A61K 35/741* (2013.01); *A61K 9/0014* (2013.01); *A61K 38/2066* (2013.01); *C07K 14/475* (2013.01); *C07K 14/485* (2013.01); *C07K 14/52* (2013.01); *C07K 14/5428* (2013.01); *C07K 14/61* (2013.01); *C07K 14/715* (2013.01); *C12N 1/20* (2013.01); *C12N 1/205* (2021.05); *A61K 2035/115* (2013.01); *C12R 2001/01* (2021.05)

(58) Field of Classification Search
None
See application file for complete search history.

(56) References Cited

U.S. PATENT DOCUMENTS

| 4,663,306 A | 5/1987 | Cantrell |
| 5,837,509 A | 11/1998 | Israelsen et al. |
| 7,179,458 B2 | 2/2007 | Chang et al. |
| 8,481,299 B2 | 7/2013 | Gueniche |
| 8,496,917 B2 | 7/2013 | Chaudhuri |
| 8,557,249 B2 | 10/2013 | Brooks et al. |
| 9,636,292 B2 | 5/2017 | Sweeney et al. |
| 9,713,596 B2 | 7/2017 | Hong et al. |
| 10,201,509 B2 | 2/2019 | Garcines et al. |
| 10,434,073 B2 | 10/2019 | Hong et al. |
| 10,471,035 B2 | 11/2019 | Bojanowski |
| 10,568,819 B2 | 2/2020 | Chaudhuri |
| 10,584,344 B2 | 3/2020 | Hitchcock et al. |
| 10,597,402 B2 | 3/2020 | Chaudhuri |
| 10,660,831 B2 | 5/2020 | Albrecht |
| 2002/0090678 A1 | 7/2002 | Kordyum et al. |
| 2003/0175274 A1 | 9/2003 | Rosen et al. |
| 2003/0199440 A1 | 10/2003 | Dack et al. |

(Continued)

FOREIGN PATENT DOCUMENTS

| EP | 0965641 A2 | 12/1999 |
| EP | 1110555 A1 | 6/2001 |

(Continued)

OTHER PUBLICATIONS

Haubner, F., et al. 2012 Radiation Oncology 7: 162 (9 pages). (Year: 2012).*
Kobayashi, K., et al. 2003 PNAS 100(8): 4678-4683. (Year: 2003).*
Rovner, A.J., et al. 2015 Nature 518: 89-93, including online content methods, extended data (18 pages total). (Year: 2015).*
Fitz-Gibbon, S., et al. 2013 Journal of Investigative Dermatology 133: 2152-2160. (Year: 2013).*

(Continued)

*Primary Examiner* — Marsha Tsay
(74) *Attorney, Agent, or Firm* — Michael Best & Friedrich LLP

(57) ABSTRACT

Microbes can be genetically modified to express biomolecules that are beneficial to mammals and/or to reduce, or eliminate, expression of harmful virulence factors. The growth and viability of such genetically modified microbes can optionally be controlled by inducible promoters that regulate the expression of proteins that are essential to their growth and survival. Compositions comprising such genetically modified microbes as well as methods of making and using the same are disclosed herein.

11 Claims, 19 Drawing Sheets
Specification includes a Sequence Listing.

(56) References Cited

U.S. PATENT DOCUMENTS

| | | |
|---|---|---|
| 2006/0183188 A1 | 8/2006 | Pel et al. |
| 2008/0207515 A1 | 8/2008 | Ferguson et al. |
| 2008/0248477 A1 | 10/2008 | Holtzman et al. |
| 2009/0022700 A1 | 1/2009 | Cassin et al. |
| 2009/0232785 A1 | 9/2009 | Breton et al. |
| 2010/0047394 A1 | 2/2010 | May |
| 2011/0027221 A1 | 2/2011 | Fu et al. |
| 2012/0301452 A1 | 11/2012 | Gueniche et al. |
| 2013/0108584 A1 | 5/2013 | Jan et al. |
| 2014/0023618 A1 | 1/2014 | Goren et al. |
| 2014/0044653 A1 | 2/2014 | Qvit-Raz et al. |
| 2014/0044677 A1* | 2/2014 | Qvit-Raz ............ A61K 35/744 424/93.2 |
| 2014/0065209 A1 | 3/2014 | Putaala et al. |
| 2015/0071957 A1 | 3/2015 | Kelly et al. |
| 2015/0086581 A1 | 3/2015 | Li et al. |
| 2015/0361436 A1 | 12/2015 | Hitchcock et al. |
| 2016/0264998 A1 | 9/2016 | Kim et al. |
| 2017/0065647 A1 | 3/2017 | Kim et al. |
| 2017/0304373 A1 | 10/2017 | Taylor et al. |

FOREIGN PATENT DOCUMENTS

| | | |
|---|---|---|
| EP | 2364712 A1 | 9/2011 |
| KR | 20090098419 A | 9/2009 |
| WO | WO9967356 A | 12/1999 |
| WO | WO2001081581 A2 | 11/2001 |
| WO | WO2003033515 A1 | 4/2003 |
| WO | WO2006058243 A2 | 6/2006 |
| WO | 2009/062339 A1 | 5/2009 |
| WO | WO2010013179 A1 | 2/2010 |
| WO | WO2010061226 A1 | 6/2010 |
| WO | WO2011060488 A1 | 5/2011 |
| WO | WO2013122931 A2 | 8/2013 |
| WO | WO2013142378 A1 | 9/2013 |
| WO | WO2014025938 A1 | 2/2014 |
| WO | WO2015195845 A1 | 12/2015 |
| WO | 2016/012607 A1 | 1/2016 |
| WO | WO2017044835 A1 | 3/2017 |
| WO | WO2017147507 A1 | 8/2017 |
| WO | WO2020099663 A1 | 5/2020 |

OTHER PUBLICATIONS

Louwen, R., et al. 2014 Microbiology and Molecular Biology Reviews 78(1): 74-88. (Year: 2014).*

Karlyshev, A.V., et al. 2005 Applied and Environmental Microbiology 71(7): 4004-4013. (Year: 2005).*

Linares, D.M., et al. 2014 Microbial Cell Factories 13:169 (9 pages). (Year: 2014).*

Husseiny, M.I, et al. 2005 Infection and Immunity 73(3): 1598-1605. (Year: 2005).*

Ouwehand et al., Probiotics for the skin: a new area of potential application?, Letters in Applied Microbiology, 2003, vol. 36, pp. 327-331.

Blinkovsky et al., Purification, characterization, and Heterologous Expression in Fusarium veneatum of a Novel Serine Carboxypeptidase from Aspergillus oryzae, Applied and Environmental Microbiology, Aug. 1999, vol. 65, No. 8, pp. 3298-3303.

Database GenBank: AAP61880, Jun. 12, 2003.

Database GenBank: AAP61879, Jun. 12, 2003.

Database GenBank: AAE15998, Sep. 29, 1999.

Database GenBank: AJN04212, Feb. 13, 2015.

Patent Cooperation Treaty, International Search Report for PCT/US2017/019476, dated Jun. 8, 2017, pp. 1-6.

International Search Report and Written Opinion for Application No. PCT/US21/38333 dated Sep. 24, 2021 (11 pages).

International Search Report and Written Opinion for Application No. PCT/US2015/0363306 dated Sep. 17, 2015 (12 pages).

Allhorn et al., "A novel enzyme with antioxidant capacity produced by the ubiquitous skin colonizer Propionibacterium acnes", Scientific Reports, 2016, pp. 1-12.

Al-Mamun et al., "Characterization and evaluation of antibacterial and antiproliferative activities of crude protein extracts isolated from the seed of Ricinus communis in Bangladesh", BMC Comp. Alt. Med., vol. 16, No. 211, 2016, pp. 1-10.

Asadullah et al., "IL-10 is a Key Cytokine in Psoriasis. Proof of Principle by IL-10 Therapy: A New Therapeutic Approach", J. Clinical Investigation, 1998, vol. 101, No. 4, pp. 783-794.

Aubin et al., "Propionibacterium acnes, an emerging pathogen: From acne to implant-infections, from phylotype to resistance", Science Direct, 2014, pp. 241-250.

Beylot et al., "Propionibacterium acnes: an update on its role in the pathogenesis of acne", JEADV, 2014, vol. 28, pp. 271-278.

Biswas et al., "High-efficiency gene inactivation and replacement system for gram-positive bacteria," J Bacteriol, 1993, 175(11): 3628-3635.

Bowe et al., "Acne vulgaris, probiotics and the gut-brain-skin-axis—back to the future?", Gut Pathogens, 2011, vol. 3, No. 1, pp. 1-11.

Brautaset et al., "Positively Regulated bacterial expression systems", Microbiol. Biotechnology, 2009, vol. 2, No. 1, pp. 15-30.

Bruggemann et al., "CriSPR/cas loci of type II Propionibacterium acnes confer immunity against acquisition of mobile elements present in type IP. Acnes", PLoS One, vol. 7, No. 3, 2012, pp. 1-10.

Bruggemann, "Insights in the Pathogenic Potential of Propionibacterium acnes from its Complete Genome", Semin. Cutan. Med. Surg., 2005, vol. 24, pp. 67-72.

Cheong et al., "Optimization of electrotransformation conditions for Propionibacterium acnes", Journal of Microbiol. Methods, 2008, vol. 72, No. 1, pp. 38-41.

De Vries et al., "Integration of foreign DNA during natural transformation of Acinetobacter sp. by homology-facilitated illegitimate recombination," PNAS, 2002, 99(4): 2094-2099.

Falentin et al., "The Complete Genome of Propionibacterium freudenreichii CIRM-BIA1T, a Hardy Actinobacterium with Food and Probiotic Applications", PLoS One, 2010, vol. 5, No. 7, e11748, 12 pages.

Holland et al., "Proteomic identificaiton of secreted proteins of Propionibacterium acnes", BMC Microbiol., 2010, vol. 10, No. 230, 11 pages.

Horvath et al., "CRISPR/Cas, the Immune System of Bacteria and Archaea", Science, 2010, vol. 327, pp. 167-170.

Husson et al., "Gene replacement and expression of foreign DNA in mycobacteria," J Bacteriol, 1990, 172(2): 519-524.

Jakab et al., "Severe Infections Caused by Propionibacterium acnes: An Underestimated Pathogen in Late Postoperative Infections", Yale Journal of Biology and Medicine, 1996, vol. 69, pp. 477-482.

Jonczyk-Matysiak et al., "Prospects of Phage Appplication in the Treatment of Acne Caused by Propionibacterium acnes", Frontiers in Microbiology, 2017, vol. 8, No. 164, pp. 1-11.

Jore et al., "Efficient Transformation System Propionibacterium freudenreichii based on a novel vector", Society, 2001, vol. 67, No. 2, pp. 499-503.

Kim et al., "Activation of Toll-Like Receptor 2 in Acne Triggers Inflammatory Cytokine Responses", The Journal of Immunology, 2002, vol. 169, pp. 1535-1541.

Le Breton et al., "Genetic Manipulation of Streptococcus pyogenes (The Group A Streptococcus, GAS)", Curr. Protoc. Microbiol., 2018, vol. 30, 33 pages.

Liu et al., "The diversity and host interactions of Propionibacterium acnes bacteriophages on human skin," The ISME Journal, 2015, 9: 2078-2093.

LSTM Liverpool School of Tropical Medicine, <http://www.lstmliverpool.ac.uk/about-lstm/news-and-media/latest-news/topical-probiotics-new-approaches>, accesssed 2014, 1 page.

Makarova et al., "Ecolution and classification of the CRISPR-Cas systems", Nat. Rev. Microbiol., 2011, vol. 9, No. 4, pp. 67-77.

McDowell et al., "The Opportunisitic Pathogen Propionibacterium acnes: Insights into Typing, Human Disease, Clonal Diversification and CAMP Factor Evolution", PLoS One, 2013, vol. 8, No. 9, e70897.

McShan et al., "Genome Sequence of a Nephritogenic and Highly Transformable M49 Strain of Streptococcus pyogenes", J. Bacteriology, 2008, pp. 7773-7785.

(56) References Cited

OTHER PUBLICATIONS

Mierau et al., "10 Years of the nisin-controlled gene expression system (NICE) in Lactococcus lactics", Appl. Micriobiol. Biotechnol., 2005, pp. 1-13.

Momoh et al., "Evaluation of the antimicrobial and phytochemical properties of oil from castor seeds (*Ricinus communis linn*)", Bul. Environ. Pharm. Life Science, vol. 1, 2012, pp. 21-27.

Munikumar et al., "In Silico Identification of Common Putative Drug Targets among the Pathogens of Bacterial Meningitis", Biochem. Anal. Biochem., 2012, vol. 1, No. 123, pp. 1-8.

Nakatsuji et al., "Dermatological Therapy by Topical Application of Non-Pathogenic Bacteria", Journal of Investigative Dermatology, 2014, vol. 134, pp. 11-14.

Ouwehand et al., "The Potential of Probiotics and Prebiotics for Skin Health", Textbook of Aging Skin, 2010, pp. 799-809.

Parizzi et al., "Te genome sequence of Propionibacterium acidipropionici provides insights into its biotechnological and industrial potential", BMC Genomics, 2012, vol. 13, 20 pages.

Portillo et al., "Propionibacterium acnes: An Underestimated Pathogen in Implant-Associated Infections", BioMed Research International, 2013, pp. 1-11.

Probiotic Action, <https://probioticaction.com>, accessed Apr. 2016, 2 pages.

Pyne et al., "Harnessing heterologous and endogenous CRISPR-Cas machineries for efficient markerless genome editing in Clostridum", Scientific Reports, 2016, pp. 1-15.

Rampadarath et al., "In vitro antimicrobial and larvicidal properties of wild Ricinus communis L. in Mauritius", Asian Pac. J. Trop. Biomedicine, vol. 6, No. 2, 2016, pp. 100-107.

Rhee et al., "Development of plasmid vector and electroporation condition for gene transfer in sporogenic lactic acid bacterium, Bacillus coagulans", Plasmid, 2007, vol. 58, No. 1, pp. 13-22.

Sanders et al., "Selected topics in probiotics and prebiotics: meeting report for the 2004 international scientific association for probiotics and prebiotics", Curr. Issues Intest. Microbiol., 2015, vol. 6, No. 2, pp. 55-68.

Sorenson et al., "Mutagenesis of Propionibacterium acnes and analysis of two CAMP factor knock-out mutants", J. Microbiol. Methods, 2010, 23 pages.

Tsai et al., "Rosmarinus officinalis Extract Suppresses Propionibacterium acnes-Induced Inflammatory Responses", J. Med. Food, 2013, vol. 16, No. 4, pp. 324-333.

Vyas et al., "Carrier-Based Drug Delivery System for Treatment of Acne", The Scientific World Journal, 2014, 14 pages.

Wang et al., "A Precision Microbiome Approach Using Sucrose for Selective Augmentation of *Staphylococcus epidermidis* Fermentation against Propionibacterium acnes", Int. J. Mal. Sci., 2016, vol. 17, No. 1870, pp. 1-12.

Xiao et al., "Structure Basis for Directional R-loop Formation and Substrate Handover Mechanisms in Type I CRISPR-Cas System", Cell, 2017, vol. 170, pp. 48-60.

Yan-bin et al., "A review on immune system of the bacteria and its s versus non-self discrimination", Chinese Veterinary Science, 2012, vol. 42, No. 6, pp. 657-660.

\* cited by examiner

SKIN PROBIOTIC FORMULATION

CROSS-REFERENCE TO RELATED APPLICATIONS

This patent application is the National Phase of International Application No. PCT/US2017/019476, filed Feb. 24, 2017, which claims the benefit of priority to U.S. Provisional Patent Application No. 62/299,237, filed Feb. 24, 2016. The entire contents of the foregoing applications are incorporated herein by reference, including all text, tables, sequence listings and drawings.

REFERENCE TO SEQUENCE LISTING

The present application is being filed with a Sequence Listing. The Sequence Listing is submitted electronically in in ASCII format via EFS-Web in the form of a text file. Said ASCII copy, created on Aug. 23, 2018, is named XycrobeSeqListing0452589.txt and is 808 kb in size, the contents of which are incorporated herein by reference in their entirety.

INTRODUCTION

The present disclosure relates to compositions comprising genetically modified microbes, methods of makings genetically modified microbes, and uses thereof. In some aspects subject matter described herein relates to the field of dermatology and compositions for topical dermatological purposes.

SUMMARY

The invention provides genetically modified microbes. In particular embodiments, a microbe is a bacterium of the genus *Propionibacterium*. In various aspects, a genetically modified bacteria of the genus *Propionibacterium* comprises a nucleic acid encoding a mammalian growth factor, or a mammalian cytokine or a vasodilator or an interleukin-1 receptor (IL-1R) antagonist. In some aspects the growth factor is a hormone. In certain aspects the growth factor is a human or bovine hormone. In certain embodiments the growth factor is a somatotrophin. In some embodiments the growth factor comprises SEQ ID NO:45, SEQ ID NO:46, SEQ ID NO:47, SEQ ID NO:48 or SEQ ID NO:49. In certain embodiments the growth factor is secreted by the bacteria. In some embodiments the growth factor is a human growth factor. In certain embodiments the growth factor is transforming growth factor beta (TGF-β), vascular endothelial growth factor (VEGF), hepatocyte growth factor (HGF), fibroblast growth factor (FGF), insulin-like growth factor-1 (IGF1), platelet derived growth factor (PDGF), granulocyte monocyte colony stimulating factor (GMCSF), epidermal growth factor (EGF) and/or human growth hormone (HGH). The growth factor can be a transforming growth factor comprising any one of SEQ ID NO:63 to SEQ ID NO:69. In some embodiments the growth factor is a hepatocyte growth factor comprising SEQ ID NO:70. In some embodiments the growth factor is a vascular endothelial growth factor (VEGF) comprising any one of SEQ ID NO:71 to SEQ ID NO:91. In some embodiments the growth factor is a platelet derived growth factor (PDGF) comprising any one of SEQ ID NO:93 to SEQ ID NO:102. In certain embodiments the growth factor is an epidermal growth factor (EGF) comprising any one of SEQ ID NO:103 to SEQ ID NO:106. In some embodiments the fibroblast growth factor (FGF) comprises any one of SEQ ID NO:107 to SEQ ID NO:144. In some embodiments the one or more bacteria secrete the mammalian growth factor or mammalian cytokine or vasodilator or interleukin-1 receptor (IL-1R) antagonist. In some embodiments the mammalian cytokine is an immunosuppressive cytokine. In some embodiments the mammalian cytokine is a human cytokine. In certain embodiments the cytokine is selected from the group consisting of interleukin-10 (IL-10), interleukin-6 (IL-6), interleukin-7 (IL-7) and interleukin-8 (IL-8). In some embodiments the cytokine is selected from the group consisting of SEQ ID NO:24, SEQ ID NO:25, SEQ ID NO:26, SEQ ID NO:27 and SEQ ID NO:28. In some embodiments the mammalian cytokine comprises IL-10. In some embodiments the IL-10 comprises SEQ ID NO:25. In some embodiments the mammalian vasodilator comprises bradykinin. In some embodiments, the interleukin-1 receptor (IL-1R) antagonist comprises any of Isoforms 1-4 (denoted Iso-1, Iso-2, Iso-3, Iso-4).

In some embodiments the genus of *Propionibacterium* comprises a species selected from the group consisting of *Propionibacterium acidifaciens*, *Propionibacterium acidipropionici*, *Propionibacterium acnes*, *Propionibacterium australiense*, *Propionibacterium avidum*, *Propionibacterium cyclohexanicum*, *Propionibacterium freudenreichii*, *Propionibacterium freudenreichii*, *Propionibacterium granulosum*, *Propionibacterium jensenii*, *Propionibacterium microaerophilum*, *Propionibacterium propionicum* and *Propionibacterium thoeniiand*. In some embodiments the strain of *P. acnes* comprises a CRISPR (clustered regularly interspaced short palindromic repeat) array. In some embodiments the strain of *P. acnes* is *P. acnes*, type II, ribotype 6 (R6 Type II *P. acnes*).

In some embodiments the nucleic acid comprises an inducible promoter configured to regulate the expression of the mammalian growth factor or the mammalian cytokine or the mammalian vasodilator or the interleukin-1 receptor (IL-1R) antagonist. In some embodiments the nucleic acid comprises an endogenous promoter configured to direct the expression of the mammalian growth factor or the mammalian cytokine or the mammalian vasodilator or the interleukin-1 receptor (IL-1R) antagonist. In some embodiments the expression of an endogenous pathogenic protein is substantially reduced or eliminated in the one or more genetically modified bacteria. In some embodiments the endogenous pathogenic protein comprises a glyceraldehyde 3-phosphate dehydrogenase (GADPH) protein or a CAMP2 protein. In some embodiments the one or more genetically modified bacteria comprise an inducible promoter regulating the expression of an essential protein. In certain embodiments an essential protein is a suitable housekeeping gene. In certain embodiments an essential protein is a suitable chromosome replication initiator protein. In some embodiments an essential protein is selected from the group consisting of a chromosome replication initiator protein DnaA, FtsA, FtsI, FtsL, FtsK, FtsN, FtsQ, FtsW, FtsZ (e.g., filamentous temperature-sensitive growth, in some embodiments genes with FTS are of this operon that codes for the constriction ring that allows for septation), cell division protein (e.g., ZipA gene), shikimate 5-dehydrogenase (e.g., AROE, aroE gene), an ATP synthase (e.g., ATP synthase, F1 complex, β subunit, e.g., an atpD gene), guanylate kinase (e.g., gmk), GMP synthase (e.g., guaA), GTP binding protein (e.g., lepA), recombinase A protein (e.g., recA), superoxide dismutase (e.g., sodA gene). In some embodiments an inducible promoter is inducible by a sugar, such as lactose or arabinose. In some embodiments the inducible promoter is inducible by an amino acid, such as a synthetic amino acid. In some embodiments the composition is configured for topical or mucosal administration to a mammal.

In certain embodiments a genetically modified microbe, such as a bacterium of the species *Propionibacterium acnes*, comprises multiple genetic modifications. In a particular aspect, a modified microbe 1) expresses a mammalian growth factor, wherein the mammalian growth factor is secreted; 2) includes an inducible promoter directing expression of an essential protein, for example, a chromosome replication initiator protein DnaA, FtsA, Ftsl, FtsL, FtsK, FtsN, FtsQ, FtsW, FtsZ, ZipA, aroE, atpD, gmk, guaA, lepA, recA, or sodA; and 3) is modified such that expression of an endogenous CAMP2 and/or endogenous GADPH protein is substantially reduced or eliminated. In another particular aspect, a genetically modified microbe, such as a bacteria of the species *Propionibacterium acnes*, comprises 1) a human cytokine, such as IL10, wherein the cytokine (e.g., I10) is secreted; 2) includes an inducible promoter directing expression of an essential protein (e.g., an essential protein and/or a gene encoding an essential protein), for example, a chromosome replication initiator protein DnaA, FtsA, Ftsl, FtsL, FtsK, FtsN, FtsQ, FtsW, FtsZ, ZipA, aroE, atpD, gmk, guaA, lepA, recA, or sodA; and 3) is modified such that expression of an endogenous CAMP2 and/or endogenous GADPH protein is substantially reduced or eliminated. Additional embodiments also include mammalian vasodilator or interleukin-1 receptor (IL-1R) antagonist, e.g., a genetically modified microbe, such as a bacteria of the species *Propionibacterium acnes* that comprises 1) a vasodilator or interleukin-1 receptor (IL-1R) antagonist which is secreted; 2) includes an inducible promoter directing expression of an essential protein (e.g., an essential protein and/or a gene encoding an essential protein), for example, a chromosome replication initiator protein DnaA, FtsA, Ftsl, FtsL, FtsK, FtsN, FtsQ, FtsW, FtsZ, ZipA, aroE, atpD, gmk, guaA, lepA, recA, or sodA; and 3) is modified such that expression of an endogenous CAMP2 and/or endogenous GADPH protein is substantially reduced or eliminated.

In certain embodiments a composition comprises one or more genetically modified microbes, such as a bacterium of the species *Propionibacterium acnes*. In particular aspects, a composition includes 2, 3, 4, 5, 6, 7, 8, 9, 10 or more, each of which are genetically modified, such as a bacterium of the species *Propionibacterium acnes*, in different ways. For example, a first genetically modified microbe of the composition can express a cytokine, such as IL-10, IL-6, IL-7 or IL-8; and a second genetically modified microbe of the composition can express a growth factor such as TGF-β, VEGF, HGF, FGF, IGF1, PDGF, GMCSF, EGF or HGH. Such combinations may include one or more genetically modified microbes in which expression of an endogenous pathogenic protein is substantially reduced or eliminated in the one or more genetically modified bacteria, for example, a glyceraldehyde 3-phosphate dehydrogenase (GADPH) protein or a CAMP2 protein. Such combinations may also include one or more genetically modified microbes that include an inducible promoter regulating the expression of an essential protein, such as protein is selected from a chromosome replication initiator protein DnaA, FtsA, Ftsl, FtsL, FtsK, FtsN, FtsQ, FtsW, FtsZ, ZipA, aroE, atpD, gmk, guaA, lepA, recA, and sodA. Such combinations also include genetically modified microbe, such as a bacterium of the species *Propionibacterium acnes*, with multiple genetic modifications.

In some embodiments, a genetically modified microbe, such as a bacterium of the species *Propionibacterium acnes*, comprises an inducible promoter regulating expression of an essential protein. In certain aspects, protein expression is induced or stimulated by the presence of the sugar or sugar analog, i.e., the promoter is induced by the sugar or sugar analog.

In certain embodiments a composition comprises one or more genetically modified microbes, such as a bacterium of the species *Propionibacterium acnes*, and *Propionibacterium acnes* that has not been genetically modified by the hand of man. In particular aspects, a composition includes 2, 3, 4, 5, 6, 7, 8, 9, 10 or more, each of which are genetically modified, such as a bacteria of the species *Propionibacterium acnes*, in different ways, in combination with *Propionibacterium acnes* that has not been genetically modified. Such combinations may include one or more genetically modified microbes that include an inducible promoter regulating the expression of an essential protein, such as protein is selected from a chromosome replication initiator protein DnaA, FtsA, Ftsl, FtsL, FtsK, FtsN, FtsQ, FtsW, FtsZ, ZipA, aroE, atpD, gmk, guaA, lepA, recA, and sodA. Such combinations also include genetically modified microbe, such as a bacterium of the species *Propionibacterium acnes*, with multiple genetic modifications.

Typical amounts of growth arrested strains, such as *P. acnes* (e.g., type II, ribotype 6), in such a combination will be 80%, 75%, 70%, 65%, 60%, 55%, 50%, 45%, 40%, 30%, 25% or less compared with amounts of a strain (e.g., *P. acnes*, type II, ribotype 6) that has not been genetically modified. Typical ratios of growth arrested strains, such as *P. acnes* (e.g., type II, ribotype 6) compared with amounts of a strain (e.g., *P. acnes*, type II, ribotype 6) that has not been genetically modified in such a combination will range from about 4:1-3:1, from about 3:1-2:1, from about 2:1-1:1, from about 1:1-1:2, from about 1:2-1:3, or from about 1:3-1:4.

In more particular embodiments, microbe combinations include genetically modified *Propionibacterium acnes*, with an inducible promoter regulating the expression of an essential protein comprises an arabinose promoter, and the protein is selected from a chromosome replication initiator protein DnaA, FtsA, Ftsl, FtsL, FtsK, FtsN, FtsQ, FtsW, FtsZ, ZipA, aroE, atpD, gmk, guaA, lepA, recA, and sodA. In more particular embodiments, a *Propionibacterium acnes* strain that has not been genetically modified is a *P. acnes* of ribotype RT1, RT2, RT3, RT4, RT5, RT6, RT7, RT8, RT9 or RT10, more particularly a *P. acnes* of ribotype RT2 or RT6, such as a *P. acnes* of strain Type II and ribotype RT2 or RT6.

BRIEF DESCRIPTION OF THE DRAWINGS

The drawings illustrate embodiments of the technology and are not limiting. For clarity and ease of illustration, the drawings are not made to scale and, in some instances, various aspects may be shown exaggerated or enlarged to facilitate an understanding of particular embodiments.

FIG. 10 shows an alignment of the RecA gene from a type II strain of *P. acnes* (RecA ATCC 11828, SEQ ID NO: 274) and the RecA gene from a type I strains of *P. acnes* (RecA NCTC737, SEQ ID NO: 275). Shaded areas indicated nucleotide base identity at the same base position. Numbering shown is relative to the position of the sequence within the full length gene.

FIG. 12 shows an alignment of an SNP sequence of 16S RNA of strain ATCC11828 of *P. acnes* (SEQ ID NO: 290) with SNP sequences isolated from the *P. acnes* strains isolated in Example 1 (PA_001_4_16S, SEQ ID NO: 291; PA_002_18_16S, SEQ ID NO: 292; PA_003_20_16S, SEQ ID NO: 293; PA_005_31_16S, SEQ ID NO: 294; PA_007_33_16S, SEQ ID NO: 295; PA_008_34_16S, SEQ ID NO: 296; PA_009_35_16S, SEQ ID NO: 297; PA_011_39_16S, SEQ ID NO: 298; PA_013_43_16S, SEQ ID NO: 299; PA_014_44_16S, SEQ ID NO: 300; PA_015_45_16S, SEQ ID NO: 301; PA_017_48_16S, SEQ ID NO: 302). Shaded areas indicated nucleotide base identity at the same base position.

DETAILED DESCRIPTION

Figure 1:
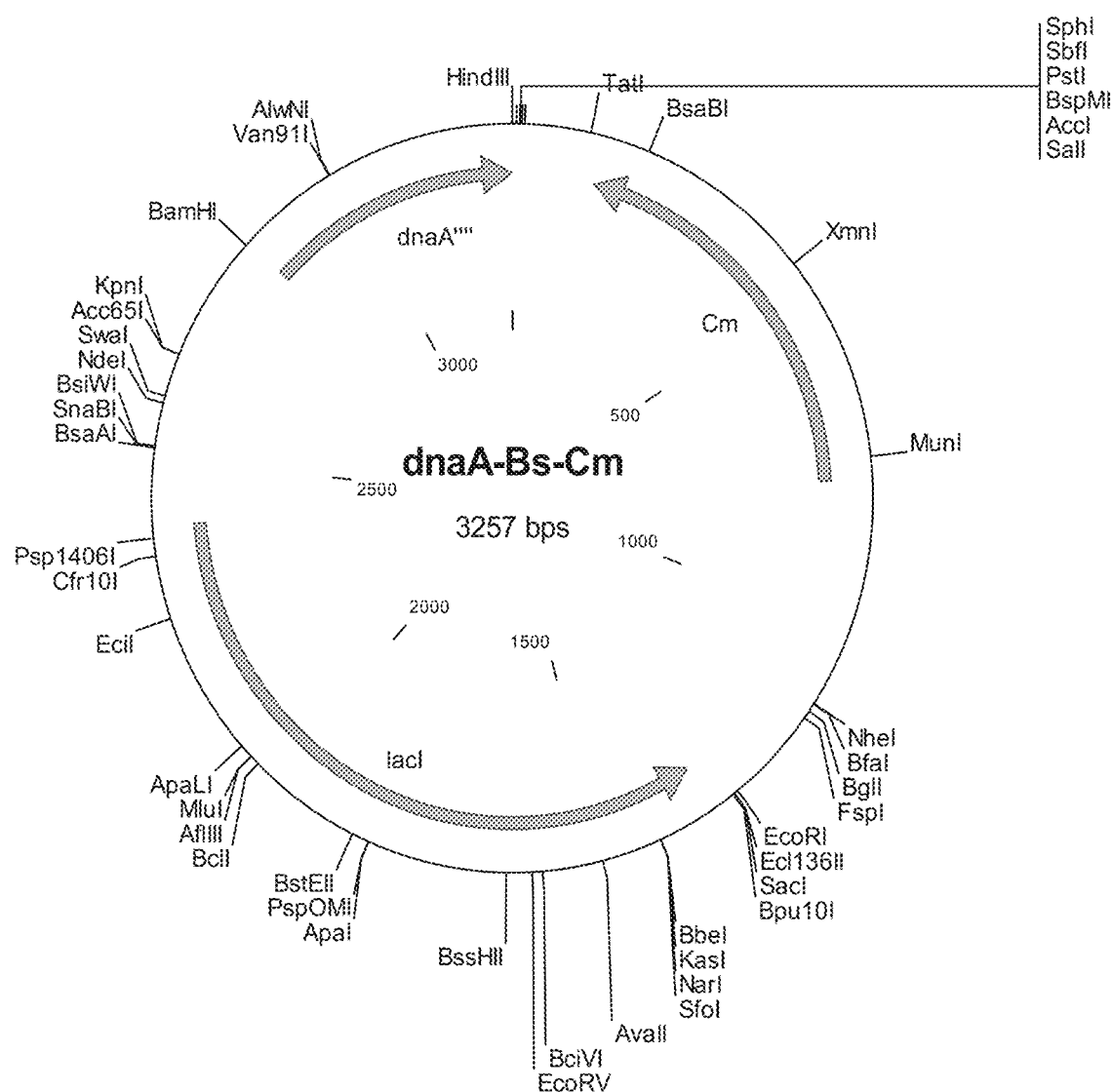
FIG. 1 shows a plasmid map of dnaA-Bs-Cm: A self-ligated DNA for construction of the growth arrest strain of *Bacillus subtilis*.
Figure 2:
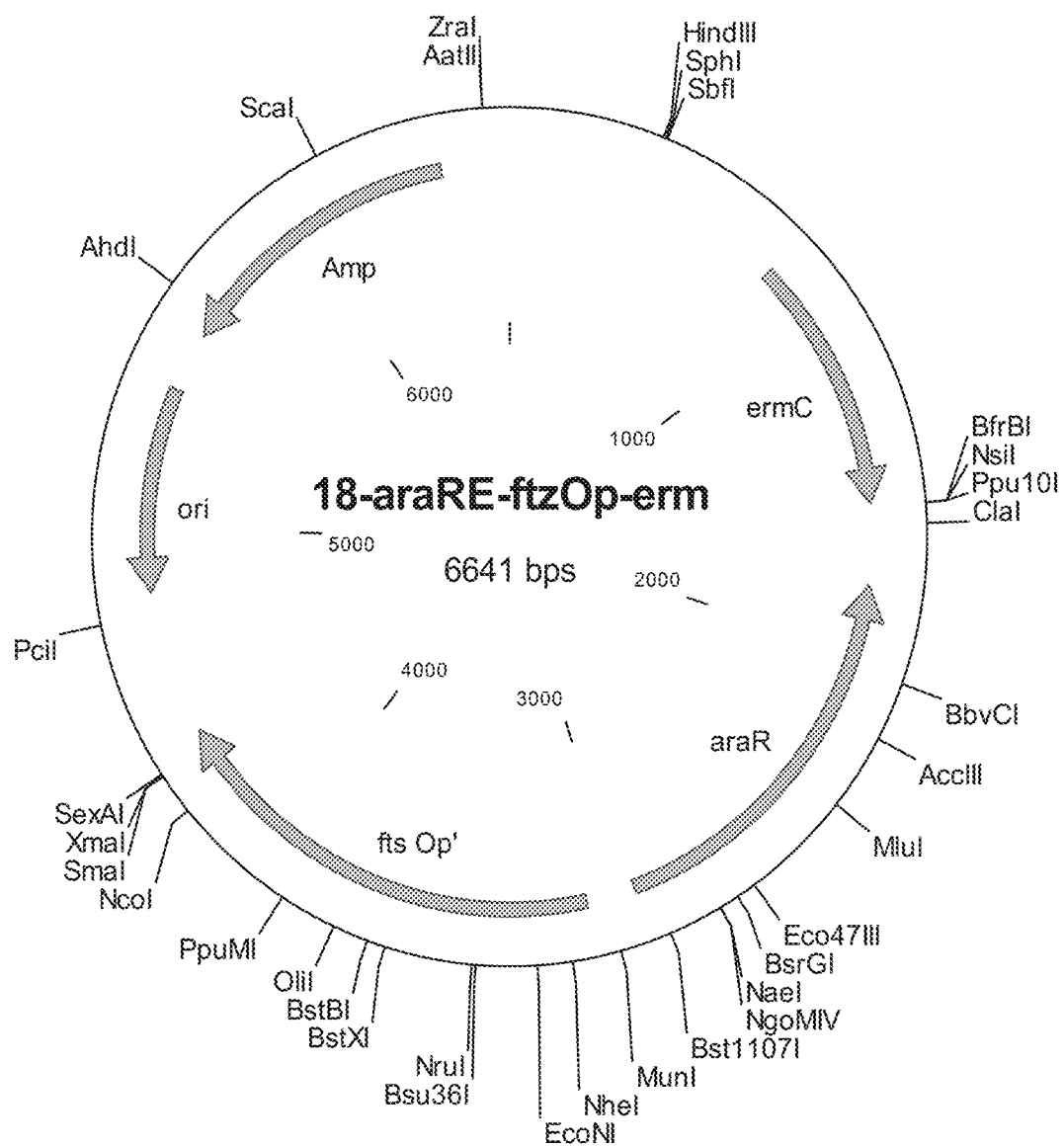
FIG. 2 shows a plasmid map of 18-araRE-ftsOp-erm: A plasmid for construction of the growth arrest strains of *P. acnes* I, Arabinose inducible fts operon.
Figure 3:
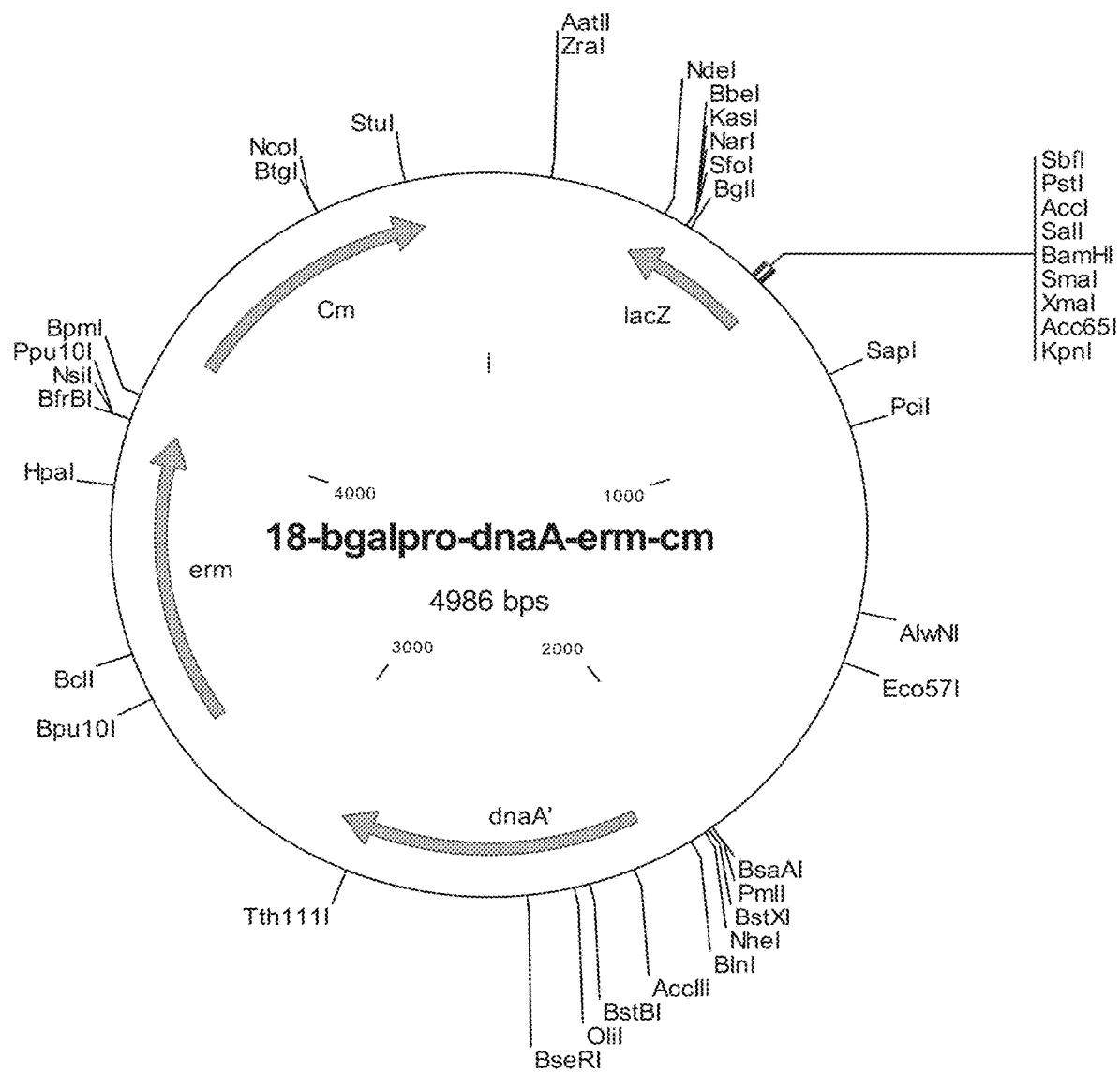
FIG. 3 shows a plasmid map of 18-bgalpro-dnaA-erm-cm: A plasmid for construction of the growth arrest strains of *P. acnes* II, Lactose inducible dnaA.
Figure 4A:
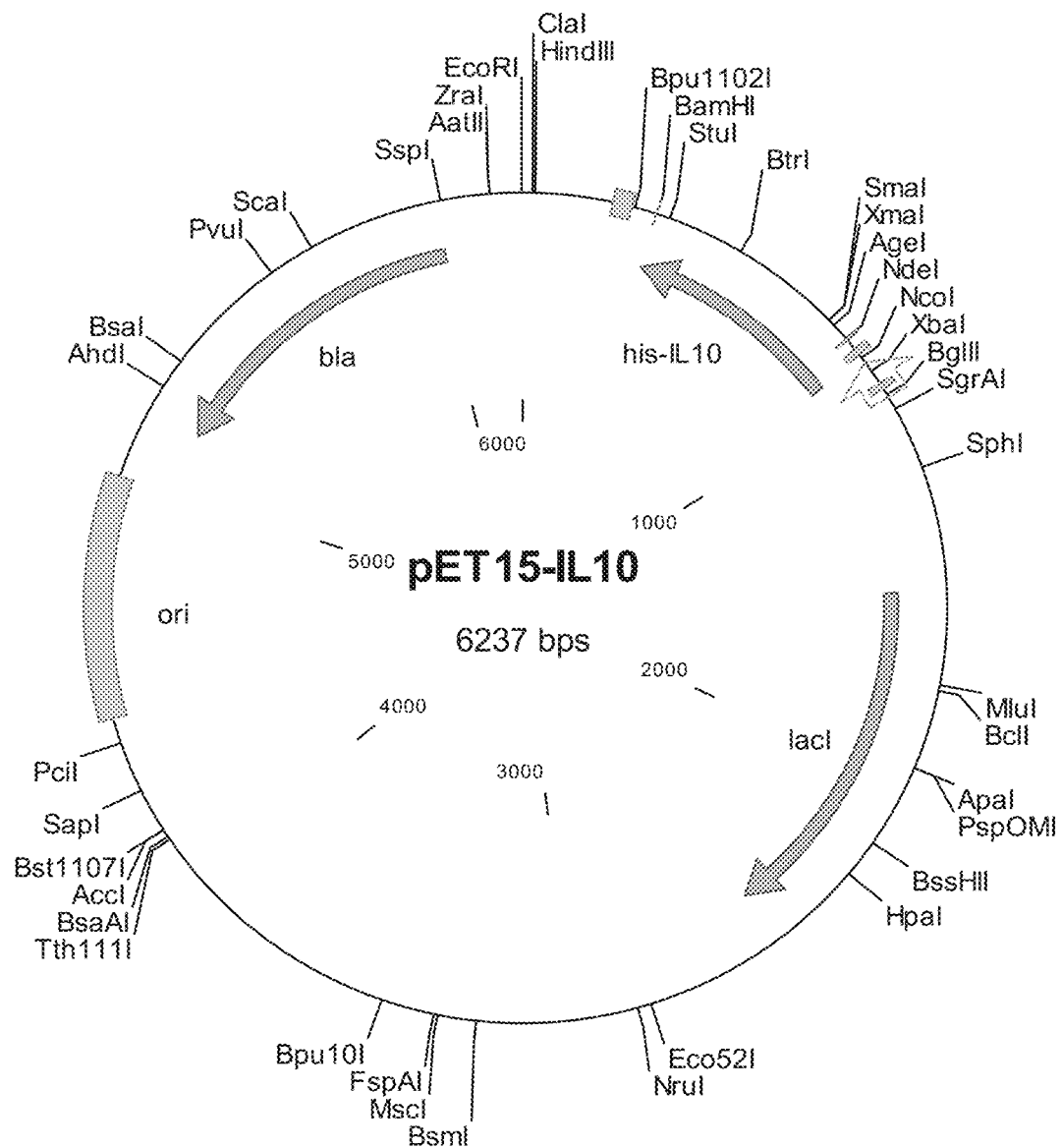
FIG. 4A shows a plasmid map of protein expression vector pET15-IL10: An expression vector for IL-10.
Figure 4B:
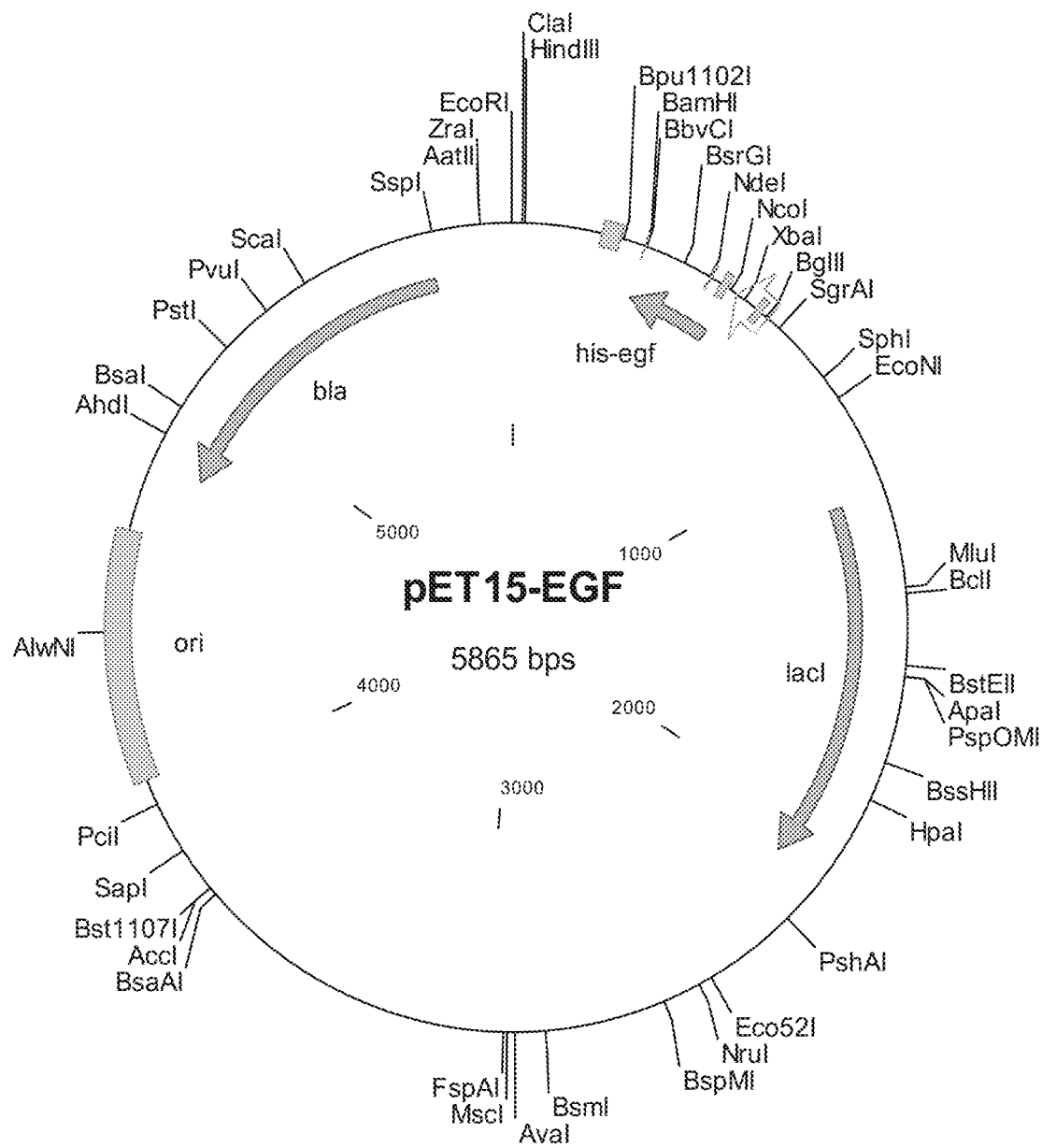
FIG. 4B shows a plasmid map of protein expression vector pET15-EGF: An expression vector for EGF.
Figure 4C:
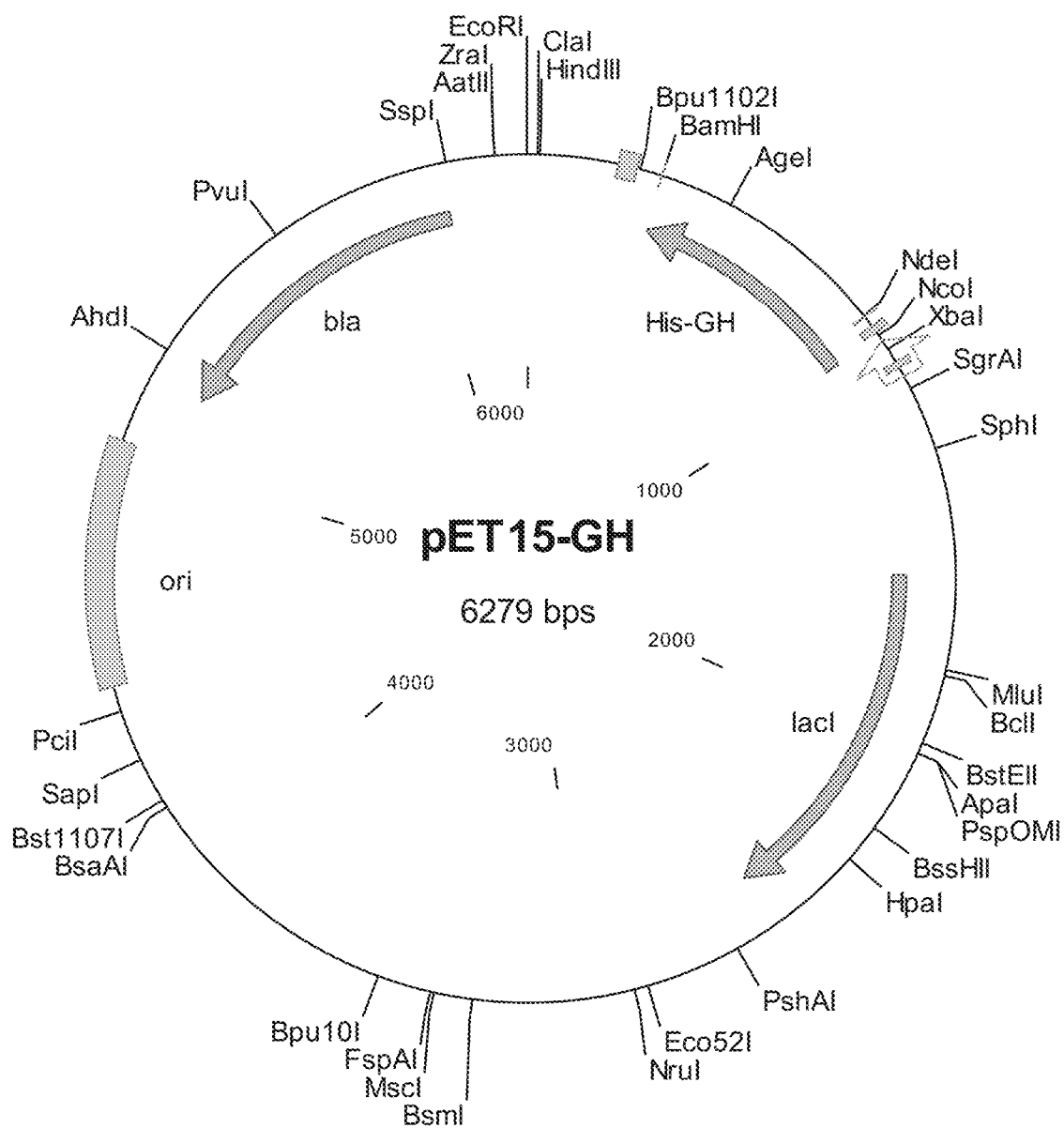
FIG. 4C shows a plasmid map of protein expression vector pET15-GH: An expression vector for GH.
Figure 5:
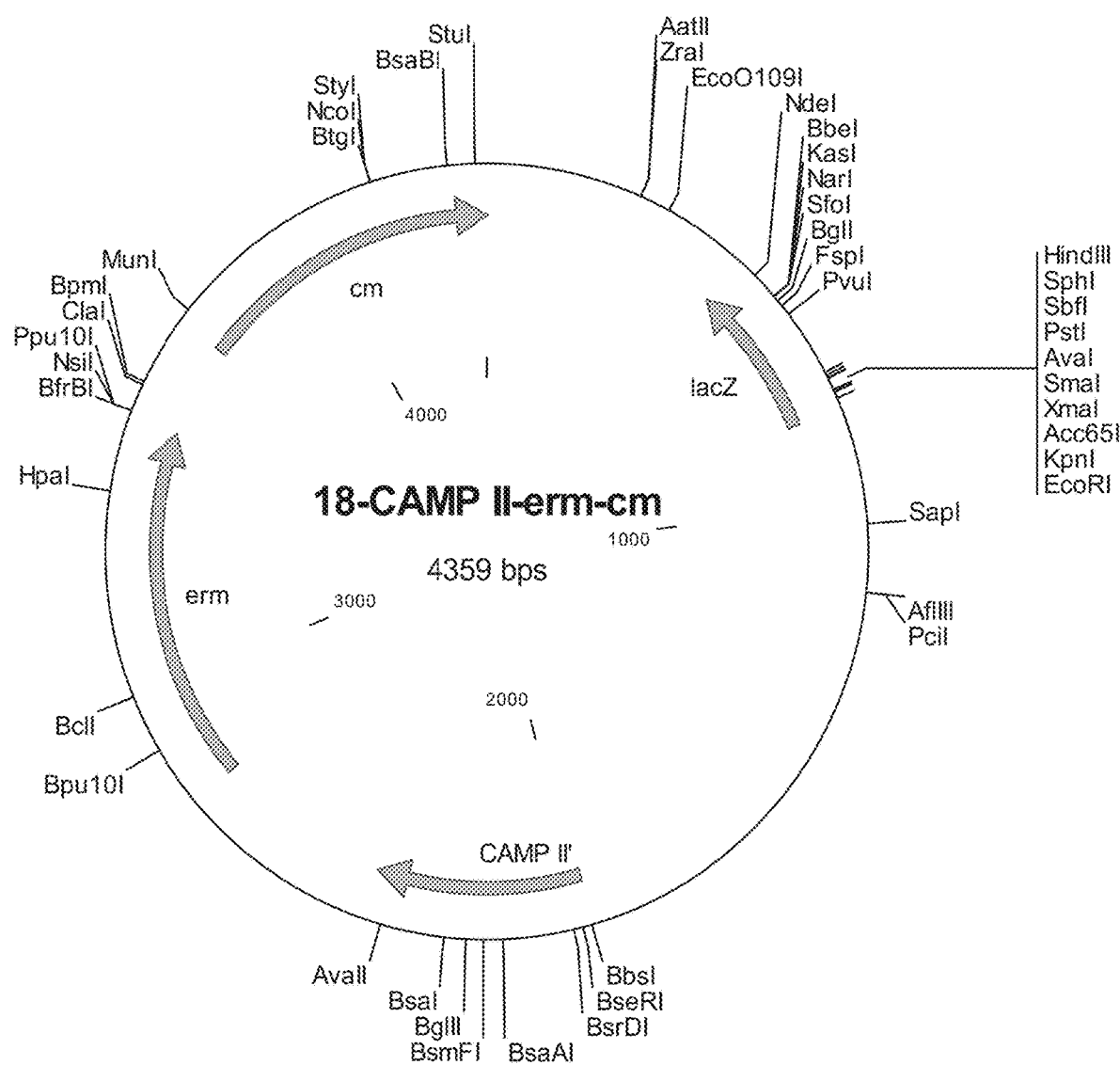
FIG. 5 shows a plasmid map of 18-CAMPII-erm-cm: A plasmid for construction of CAMPII mutant *P. acnes* strain.
Figure 6:
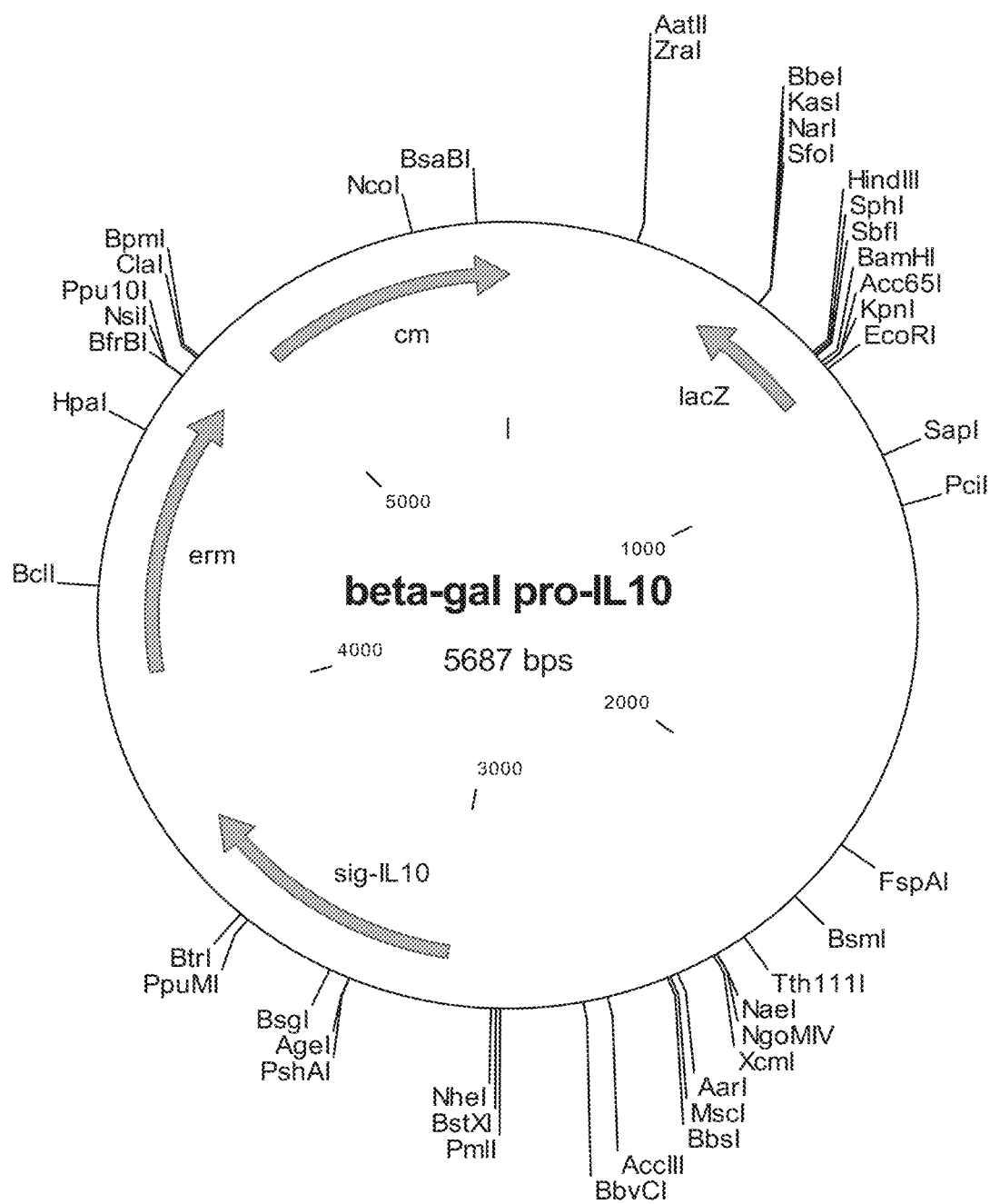
FIG. 6 shows a plasmid map of beta-galpro-IL10: A plasmid for construction of lactose inducible IL10 secretion *P. acnes* strain.
Figure 7:
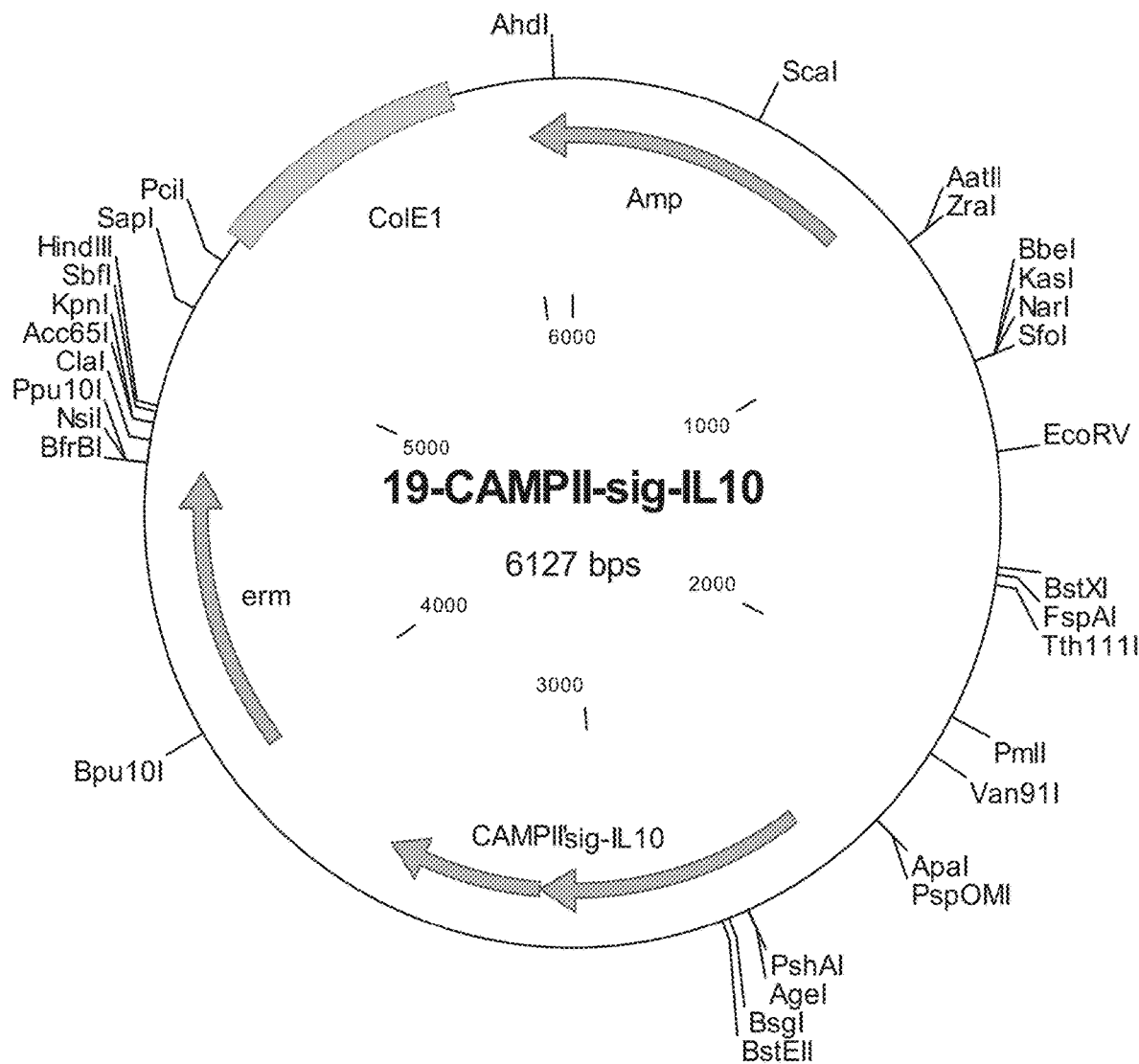
FIG. 7 shows a plasmid map of 19-CAMPII-sig-IL10: A plasmid for construction of CAMPII mutant and IL-10 expression strain of *P. acnes*.
Figure 8:
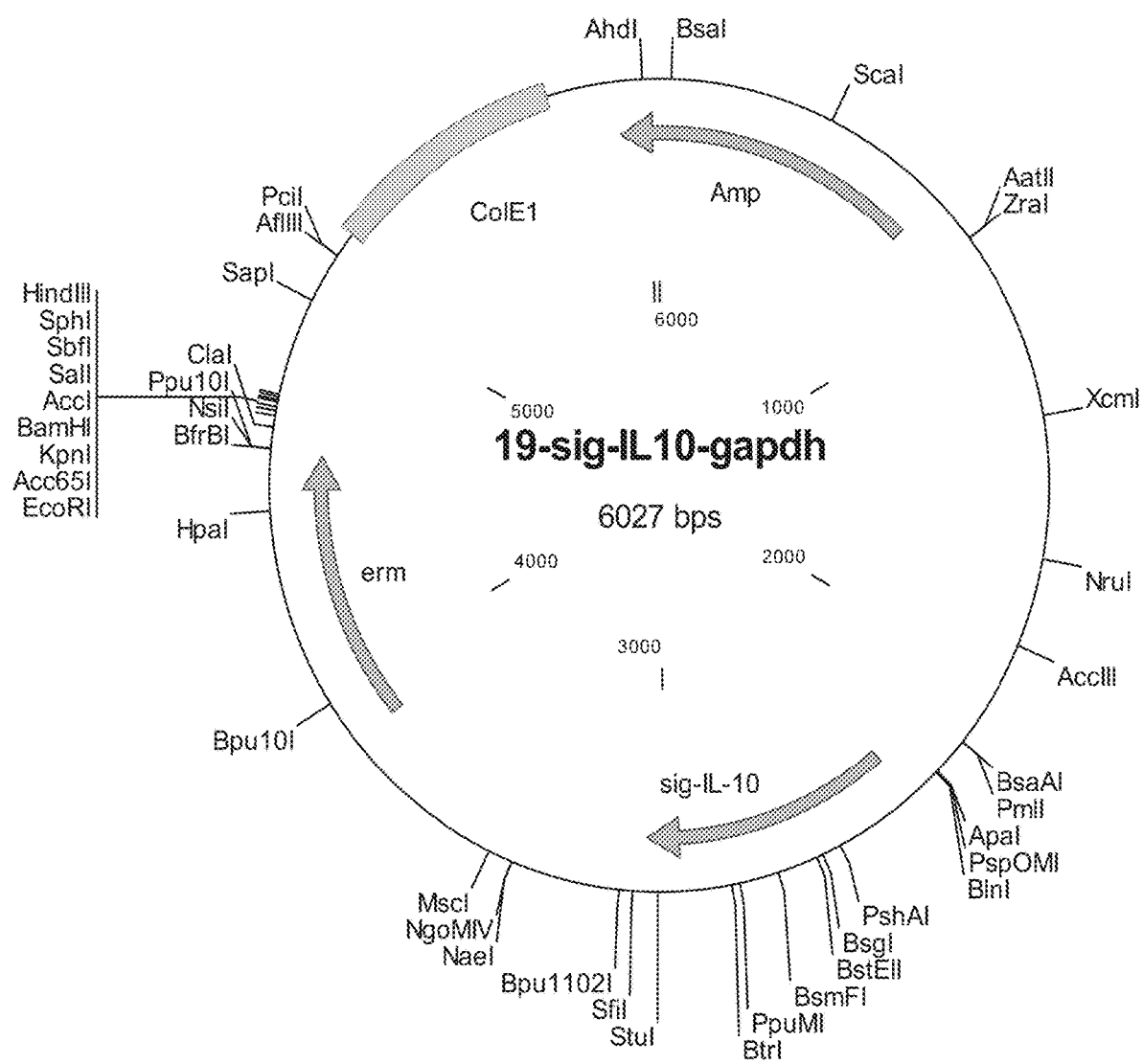
FIG. 8 shows a plasmid map of 19-sig-IL10-gapdh: A plasmid for construction of GAPDH mutant and IL-10 expression strain of *P. acnes*.

Unless otherwise indicated herein, the materials described in this section are not prior art to the claims in this application and are not admitted to be prior art by inclusion in this section.

Disclosed herein are genetically modified microbes and compositions comprising genetically modified microbes. Microbes, such as bacteria, can be genetically modified to express and/or secrete biomolecules that are beneficial to mammals. In certain embodiments genetically modified bacteria are further modified to substantially reduce, or eliminate, expression of harmful virulence factors (e.g., toxins or antigens). In some embodiments the growth and viability of such genetically modified microbes can be controlled/modulated by introduction of nucleic acids comprising inducible promoters that regulate the expression of proteins that are essential to the growth and/or survival of the modified microbes. In certain embodiments compositions comprising such genetically modified microbes are formulated for topical delivery to the skin of a mammal.

Microbes, or microorganisms, as used herein, can refer to microscopic organisms, single cell organisms, or multicellular organisms. Examples of microbes can include but are not limited to bacteria, archaea, protozoa, and fungi. In certain embodiments a microbe is a bacterium.

A "genetically modified organism" as used herein, can refer to an organism in which the genetic material of the organism has been altered using genetic engineering techniques. The term genetically modified also refers to multiple genetic modifications, e.g. 2, 3, 4, 5, 6, 7, 8, 9, 10 or more genetic modifications, for example, a microbe which has an exogenous gene introduced for expression of a protein, and a modification, such as a gene knockout, which reduces expression of an endogenous (microbe) gene encoding a pathogenic molecule (e.g., a pathogenic peptide or protein).

Microbes such as bacteria, eubacteria, yeast, fungi, can be genetically modified in order to produce one or more proteins, produce a biotherapeutic, alter metabolism, prevent overgrowth, and/or prevent expression of a biomolecule. In some embodiments a genetically modified organism is a genetically modified microbe. In some embodiments a genetically modified organism is a genetically modified bacterium. In certain embodiments a *P. acnes* bacterium is genetically modified. Those skilled in the art will appreciate that there are multiple ways to produce a genetically modified organism such as by producing a gene knockout, by introducing heterologous nucleic acids and/or by generating mutations.

In some embodiments a nucleic acid (e.g., a gene, or portion thereof) is introduced into a microbe using a suitable technique. In some embodiments a microbe is transformed with a nucleic acid by a suitable technique. Non-limiting examples of suitable techniques for introducing a nucleic acid into a microbe include electroporation, transduction (e.g., injection of a nucleic acid by a bacteriophage), microinjection, by inducing competence (e.g., by addition of alkali cations, cesium, lithium, polyethylene glycol or by osmotic shock), the like or combinations thereof. A nucleic acid can be introduced into a microbe in the form of a linear or circular plasmid, for example. In some embodiments transformed microbes are selected for integration of a nucleic acid into the genome of the microbe by using a suitable selection method (e.g., a selection marker).

A gene encodes a specific protein, which after expression via transcription and translation fulfills a specific biochemical function within a living microbe. A gene sometimes includes segments of DNA involved in producing a polypeptide chain and sometimes includes regions preceding and following a coding region (e.g., an open reading frame) involved in the transcription/translation of a gene product and the regulation of the transcription/translation. An essential gene is an endogenous gene (e.g., endogenous to a microbe) that produces a polypeptide (e.g., an essential protein) that is necessary for the growth and/or viability of a microbe. Non-limiting examples of essential proteins of a bacterium include DnaA, FtsA, FtsI, FtsL, FtsK, FtsN, FtsQ, FtsW, FtsZ, ZipA, aroE, atpD, gmk, guaA, lepA, recA, and sodA.

A "gene knockout" as used herein, refers to a combination of genetic techniques that can render a specific gene inoperable or inactive. In some embodiments a gene knockout reduces or eliminates expression of a polypeptide from the gene. In certain embodiments the expression of gene is substantially reduced or eliminated. Substantially reduced means that the expression of a gene is reduced by at least 80%, at least 90%, at least 95% or at least 98% when compared to an endogenous level of expression of a gene. Expression of a gene can be determined by a suitable technique (e.g., by measuring transcript or expressed protein levels). Any suitable technique can be used to generate a gene knockout in a microbe (e.g., a bacteria). Gene knockouts in microbes can be made by transposon mutagenesis, in vitro genetic engineering to modify genes contained on plasmids or Bacterial Artificial Chromosomes (BACs) and moving the modified construct to the organism of interest, in vivo homologous recombination, and other techniques that are known to those skilled in the art. In certain embodiments a gene is knocked out by disabling an endogenous promoter, operon or regulatory element that is essential for transcription or translation of a gene. In some embodiments a gene is knocked out by introducing one or more mutations that disable the function of a protein expressed from a gene. In certain embodiments a gene is partially or completely removed from the genome of a microbe. In some embodiments an endogenous gene is knocked out by replacing the gene with a different gene (e.g., a heterologous gene, or non-functional gene).

In some embodiments, microbes are genetically modified to prevent secretion of a pathogenic molecule (e.g., a pathogenic peptide or protein). In some embodiments a pathogenic molecule is a toxic molecule (e.g., a toxin). In certain embodiments a gene encoding a pathogenic molecule and/or a toxic molecule is knocked out. In certain embodiments a bacterium is genetically modified to substantially reduce or eliminate the expression of a pathogenic molecule or a toxic molecule. Non-limiting examples of toxic molecules include bacterial endotoxins, bacterial exotoxins and bacterial antigens. A bacterial antigen is any bacteria derived molecule (e.g., compound or protein) than induces an immune response in a mammal. In some embodiments a pathogenic molecule is a Christie-Atkins-Munch-Petersen (CAMP) factor (e.g., a CAMP factor of P. acnes). In certain embodiments one or more CAMP factors (e.g., CAMP1, CAMP2, CAMP3, CAMP4 and/or CAMP5) of P. acnes are knocked out. In certain embodiments a P. acnes bacterium is genetically modified to substantially reduce or eliminate the expression of one or more CAMP factors. In some embodiments a pathogenic molecule is a bacterial glyceraldehyde 3-phosphate dehydrogenase (GAPDH) (e.g., a GAPDH of P. acnes). In certain embodiments one or more GAPDH genes of P. acnes are knocked out. In certain embodiments a P. acnes bacterium is genetically modified to substantially reduce or eliminate the expression of GAPDH.

In some embodiments, microbes are genetically modified to create nutritional auxotrophs. In some embodiments, microbes are genetically modified to prevent acceptance of genetic material. In some embodiments, microbes naturally or are genetically modified to prevent donation of genetic material. In some embodiments, the gene for Competence Protein ComEA is modified to prevent donation of genetic material. In some embodiments, the gene for Competence Protein ComEA is modified to prevent acceptance of genetic material. In some embodiments, the gene for Competence Protein ComFA is modified to prevent donation of genetic material. In some embodiments, the gene for Competence Protein ComFA is modified to prevent acceptance of genetic material. In some embodiments, the gene for Competence Protein ComA is modified to prevent donation of genetic material. In some embodiments, the gene for Competence Protein ComA is modified to prevent acceptance of genetic material. In some embodiments, the gene for Competence Protein ComK is modified to prevent donation of genetic material. In some embodiments, the gene for Competence Protein ComK is modified to prevent acceptance of genetic material. In certain embodiments a microbe comprises a CRISPR array, or a CRISPR array is introduced into a microbe (e.g., bacteria) to prevent or reduce acceptance of foreign genetic material from other microbes.

Genetic modification of the microbes can also be performed to introduce non-functional, and non-detrimental changes to the genome, in which there is no detrimental phenotype to the microbe. A "genetic marker" as described herein, refers to an introduced non-functional sequence in a genome in order to detect the presence of a genetically modified organism or microbe. Any suitable genetic marker can be incorporated into a genetically modified microbe using a suitable technique. Genetic modification can be performed in order to catalog and distinguish genetically modified microbes from wild type microbes, and in order to determine the presence of a genetically modified microbe in an environment. The genetically modified microbe can be determined in an environment by swabbing the source containing the suspected genetically modified microbe, growing up the microbe in a minimal media culture, obtaining the genetic material, using qPCR with specific primers to the sequence of interest, and sequencing the DNA of the genetically modified microbe. The use of genetic modification to introduce a specific genetic tag can allow one to catalog and determine the presence of genetically modified microbes on a subject of need. Furthermore, the techniques can allow one to determine that the genetically modified microbe is absent from the environment when the microbe is no longer needed. In some embodiments, microbes are genetically modified to carry a marker for determining the presence or absence of a genetically modified microbe on a host. Markers for determining the propagation of genetically modified bacteria can also be used to analyze the microflora of the subject to ensure that the bacteria are balanced during treatment.

Genetically modified microbes can be used to secrete biomolecules (e.g., proteins) to treat disorders in a subject in need. Genetically modified microbes can be used to treat subjects in need suffering from a skin disorder. Genetically modified microbes carrying nucleic acid for the controlled expression of peptides can be advantageous as they can move on the skin and propagate deep into the pores and hair follicles allowing absorption of secreted biomolecules. The microbes can be formulated for and used for general cosmesis, for example.

In several embodiments described herein, genetically modified microbes can be used to treat subjects suffering from a genetic disorder. In several embodiments herein, genetically modified microbes can be used to treat subjects suffering from gastric diseases. In several embodiments herein, genetically modified microbes can be used to treat subjects suffering from autoimmune diseases. In several embodiments, genetically modified microbes can be used to treat subjects treated with anticoagulants. In several embodiments, genetically modified microbes can be used to treat subjects suffering from hemophilia. Genetically modified microbes including nucleic acids for peptides for treatment can be used in conjunction in order to meet the needs of a subject in need. In some embodiments, a second genetically modified microbe can be used to treat a subject in need. In some embodiments, a third genetically modified microbe can be used to treat a subject in need. In some embodiments, more than three genetically modified microbes can be used to treat a subject in need.

In certain embodiments a genetically modified microbe comprises a nucleic acid (e.g., a gene) where expression of the gene is regulated by a promoter. A promoter is often introduced at a suitable location relative to a gene of interest. For example, a promoter (e.g., an inducible promoter) is often placed 5' of a transcription start site of a gene of interest. In certain embodiments a nucleic acid includes a promoter and/or regulatory elements necessary to drive the expression of a gene (e.g., a heterologous gene or an endogenous gene). A promoter can be an endogenous promoter, a heterologous promoter or a combination thereof. In some embodiments a promoter is a constitutive promoter (e.g., a T7, SP6, T3, or any suitable constitutive promoter). In some embodiments a microbe is genetically altered to include a gene (e.g., a gene of interest, an essential gene) under the control of an inducible promoter. An inducible promoter is often a nucleic acid sequence that directs the conditional expression of a gene. An inducible promoter can be an endogenous promoter, a heterologous promoter, or a combination thereof. An inducible promoter can comprise an operon system. An inducible promoter is often configured to regulate the expression of a gene (e.g., a gene of interest, an essential gene). In certain embodiments an inducible promoter comprises one or more genes, regulatory elements and/or gene products (e.g., an inducible system). In some embodiments an inducible promoter requires the presence of a certain compound, nutrient, amino acid, sugar, peptide, protein or condition (e.g., light, oxygen, heat, cold) to induce gene activity (e.g., transcription). In certain embodiment an inducible promoter comprises one or more repressor elements. In some embodiments an inducible promoter (e.g., a promoter comprising a repressor element) requires the absence of a certain compound, nutrient, amino acid, sugar, peptide, protein or condition to induce gene activity (e.g., transcription). Any suitable inducible promoter, system or operon can be used to regulate the expression of a gene (e.g., an essential gene). Non-limiting examples of inducible promoters include lactose regulated systems (e.g., lactose operon systems), sugar regulated systems, metal regulated systems, steroid regulated systems, alcohol regulated systems, IPTG inducible systems, arabinose regulated systems (e.g., arabinose operon systems, e.g., an ARA operon promoter, pBAD, pARA, $P_{ARA}E$, $_{ARA}E$, $_{ARA}R$-$P_{araE}$, portions thereof, combinations thereof and the like), synthetic amino acid regulated systems (e.g., see Rovner A J, et al., (2015) Nature 518(7537):89-93), fructose repressors, a tac promoter/operator (pTac), tryptophan promoters, PhoA promoters, recA promoters, proU promoters, cst-1 promoters, tetA promoters, cadA promoters, nar promoters, $P_L$ promoters, cspA promoters, the like or combinations thereof. In certain embodiments a promoter comprises a Lac-Z (LacZ) promoter, or portions thereof. In some embodiments a promoter comprises a Lac operon, or portions thereof. In some embodiments an inducible promoter comprises an ARA operon promoter, or portions thereof.

In certain embodiments an inducible promoter comprises an arabinose promoter or portions thereof. An arabinose promoter can be obtained from any suitable bacteria. In certain embodiments an inducible promoter comprises an arabinose operon of E. coli or B. subtilis. In certain embodiments an inducible promoter is activated by the presence of a sugar or an analog thereof. Non-limiting examples of sugars and sugar analogs include lactose, arabinose (e.g., L-arabinose), glucose, sucrose, fructose, IPTG, and the like.

The use of microbes for the production of biomolecules can also be controlled for a measure of safety. In some embodiments a genetically modified microbe is engineered as a nutritional auxotroph where the growth and/or survival of the microbe depends on the presence of an essential nutrient. In some embodiments a composition herein comprises such an essential nutrient. Nutritional auxotrophs can be controlled by the depletion of supplied nutrients in order to prevent microbe overgrowth, or to remove the microbe from the environment. For example, for Trp auxotrophs, the supply for tryptophan can be removed or depleted in order to slow the microbe growth or to remove the microbe from the environment completely. In the case of Lys auxotrophs, for example, the supplied lysine can be removed from the environment to slow the growth of the Lys auxotroph or to remove it completely from the environment. For arabinose auxotrophs, the supply for arabinose can be removed or depleted in order to slow the microbe growth or to remove the microbe from the environment completely. In certain embodiments a composition comprises an amino acid such as lysine (Lys) or tryptophan (Trp). In certain embodiments a composition comprises a sugar such as arabinose. In some embodiments, the supplied nutrient can be applied as a compound in a revitalizing topical composition in order to maintain the microbe in the environment as needed.

Disclosed herein are methods for making a nucleic acid for controlled expression of a peptide for treatment. Gene transcripts for the peptide for treatment can be synthesized through standard molecular cloning techniques known to those skilled in the art and can be used to transform microbes to carry the encoded gene transcript of interest. In certain embodiments an inducible promoter comprises an operon. In some embodiments, a nucleic acid includes an operon sequence. An operon can be used to control expression of the gene transcript or the expression of a peptide for treatment at the DNA level. In some embodiments, the operon is a lac operon. In some embodiments, the operon is a Trp operon. In some embodiments, the operon is a repressor operon. Repressor operons as described herein, refers to operons that are controlled by a repressor, or a DNA or RNA binding protein, that can inhibit the expression of one or more genes by binding to the operator, or operon. In a lac operon, the gene is turned off if there is a level of lactose that can bind to the operator and inhibit the RNA polymerase from binding, thus decreasing transcription of the gene of interest. The trp operon is also a repressor operon that works through a negative repressible feedback mechanism. The repressor for the trp operon is tryptophan, which can bind to the operator and prevent transcription of the gene. By controlling the production of the gene of interest by an operon, one can control the level of production of the peptide of treatment by supplying the microbes with the repressor molecule to control the level of secreted biomolecules that are being produced. In some embodiments, the expression of peptide for treatment can be repressed by adding a repressor molecule. In some embodiments, the repressor molecule is tryptophan. In some embodiments, the repressor molecule is lactose.

Biomolecules as described herein, refer to any type of molecule that is produced by a living organism. The biomolecules can include but are not limited to macromolecules, proteins, sugars, polysaccharides, lipids, nucleic acids, peptides, metabolites, glycolipids, sterols, growth factors, hormones, glycerolipids, vitamins, neurotransmitters, metabolites, enzymes, monomers, oligomers, and polymers. Biomolecules can be produced by microbes. In certain embodiments a gene of interest encodes a biomolecule. In several embodiments described herein, methods are described in which genetically modified microbes secrete a biomolecule. In several embodiments, methods are described in which genetically modified microbes carry an enzyme that catalyzes the production of a biomolecule. In several embodiments, methods are described in which genetically modified microbes carry an enzyme that catalyzes the production hyaluronic acid. In several embodiments, methods are described in which genetically modified microbes carry an enzyme that catalyzes the production of melanin. Different types of biomolecules can be used to treat subjects in need. In some embodiments, the subject suffers from skin disorders, genetic disorders, diseases, autoimmune disease, gastric disease, aging damage, and hemophilia. In some embodiments a subject or a subject in need suffers from acne.

In certain embodiments a microbe is genetically modified to express and/or secrete a growth factor. A growth factor can be a mammalian growth factor (e.g., a human growth factor).

Growth factors are naturally occurring biomolecules that are capable of initiating and stimulating cellular growth, causing cell signaling, proliferation, healing, and the differentiation of cells. Growth factors can be a protein or a peptide. In some embodiments a growth factor is a hormone (e.g., a mammalian hormone). In certain embodiments a bacterium is genetically modified by introduction of a nucleic acid that encodes one or more growth factors (e.g., a mammalian growth factors). A nucleic acid that encodes a growth factor may include a suitable promoter and/or regulatory elements that drive the transcription and/or translation (e.g., expression) of the growth factor, an open reading frame that encodes the growth factor and, in some embodiments, suitable nucleic and/or peptide elements that direct microbial secretion of the growth factor. In certain embodiments a bacterium is genetically modified by introduction of two or more nucleic acids that encode two or more growth factors (e.g., a mammalian growth factors). In certain embodiments a bacterium is genetically modified by introduction of a nucleic acid that directs the expression of one or more growth factors (e.g., a mammalian growth factors).

In certain embodiments a bacterium is genetically modified to express and/or secrete a growth factor (e.g., a mammalian growth factor).

Several examples of growth factors include but are not limited to vascular endothelial growth factor (VEGF), platelet derived growth factor (PDGF), adrenomedullin (AM), angiopoietin (Ang), autocrine motility factor, bone morphogenetic proteins (BMPs), brain-derived neurotrophic factor (BDNF), epidermal growth factor (EGF), erythropoietin (EPO), fibroblast growth factor (FGF), glial cell line-derived neurotrophic factor (GDNF), granulocyte colony-stimulating factor (G-CSF), granulocyte macrophage colony-stimulating factor (GM-CSF), growth differentiation factor-9 (GDF9), healing factor, hepatocyte growth factor (HGF), hepatoma-derived growth factor (HDGF), insulin-like growth factor (IGF), migration-stimulating factor, myostatin (GDF-8), nerve growth factor (NGF) and other neurotrophins, platelet-derived growth factor (PDGF), thrombopoietin (TPO), transforming growth factor alpha(TGF-α), transforming growth factor beta(TGF-β), tumor necrosis factor-alpha(TNF-α), vascular endothelial growth factor (VEGF), Wnt signaling pathway, placental growth factor (PGF), fetal bovine somatotrophin (FBS), IL-1-Co-factor for IL-3 and IL-6, IL-2-T-cell growth factor, IL-3, IL-4, IL-5, IL-6, and IL-7. In some embodiments, the genetically modified microbe (e.g., a bacteria) secretes a growth factor.

Transforming growth factor beta is a hormone that controls proliferation, differentiation and other functions in many cell types. Many cells synthesize TGFB1 and have specific receptors for it. It positively and negatively regulates many other growth factors. It plays an important role in bone remodeling as it is a potent stimulator of osteoblastic bone formation, causing chemotaxis, proliferation and differentiation in committed osteoblasts. In some embodiments the peptide for treatment includes transforming growth factor beta. TGFB can be used for general cosmesis, aging damage, general aging of tissue to cause more youthful skin by attracting fibroblasts, and causing them to produce extracellular matrix, and leading to thicker, more youthful skin. In some embodiments, the transforming growth factor beta includes SEQ ID NO: 63, SEQ ID NO: 64, SEQ ID NO: 65, SEQ ID NO: 66, SEQ ID NO: 67, SEQ ID NO: 68 or SEQ ID NO: 69.

Hepatocyte growth factor/scatter factor (HGF/SF) is a hormone for paracrine cellular growth, motility and morphogenic factor. It is secreted by mesenchymal cells and targets and can act primarily on epithelial and endothelial cells, but also acts on hematopoietic progenitor cells. It has been shown to have a major role in embryonic organ development, specifically in myogenesis, in adult organ regeneration and in wound healing.

For example, receptor tyrosine-protein kinase (MET) can transduce signals from the extracellular matrix into the cytoplasm by binding to hepatocyte growth factor/HGF ligand. This process can regulate many physiological processes including proliferation, scattering, morphogenesis and survival. Ligand binding at the cell surface induces autophosphorylation of MET, on its intracellular domain that provides docking sites for downstream signaling molecules. Following activation by ligand, there are interactions with the PI3-kinase subunit PIK3R1, PLCG1, SRC, GRB2, STAT3 or the adapter GAB1. Recruitment of these downstream effectors by MET leads to the activation of several signaling cascades including the RAS-ERK, PI3 kinase-AKT, or PLC gamma-PKC cascades. The RAS-ERK activation is associated with the morphogenetic effects, while PI3K/AKT coordinates pro-survival effects. During embryonic development, MET signaling plays a role in gastrulation, development and migration of muscles and neuronal precursors, angiogenesis and kidney formation. In adults, the cascade participates in wound healing, as well as organ regeneration and tissue remodeling.

Hepatocyte growth factor can be used for general cosmesis, to cause more youthful skin by attracting fibroblasts, and causing them to produce extracellular matrix, and leading to thicker, more youthful skin. The process can also promote differentiation and proliferation of hematopoietic cells. In some embodiments, the peptide for treatment includes hepatocyte growth factor. In some embodiments, the hepatocyte growth factor includes SEQ ID NO: 70.

Vascular endothelial growth factor (VEGF) is a signal protein that is produced by cells to stimulate vasculogenesis and angiogenesis. It is part of the system that restores the oxygen supply to tissues when blood circulation is inadequate. VEGF's normal function is to create new blood vessels during embryonic development, new blood vessels after injury, muscle following exercise, and new vessels to bypass blocked vessels. VEGFs can be used for general cosmesis, to cause more youthful skin by attracting fibroblasts, and causing them to produce extracellular matrix, and leading to thicker, more youthful skin.

VEGF-A is a growth factor active in angiogenesis, vasculogenesis and endothelial cell growth. VEGF-A induces endothelial cell proliferation, promotes cell migration, inhibits apoptosis and induces permeabilization of blood vessels. VEGF-A binds to FLT1/VEGFR1 and KDRVEGFR2 receptors, heparin sulfate, and heparin. NRP1/Neuropilin-1 binds isoforms VEGF-165 and VEGF-145. Isoform VEGF165B binds to KDR but does not activate downstream signaling pathways, does not activate angiogenesis, and inhibits tumor growth. In some embodiments, the peptide for treatment includes VEGF-A. In some embodiments, VEGF-A includes SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, or SEQ ID NO: 87.

VEGF-B is a growth factor for endothelial cells. VEGF-B167 binds heparin and neuropilin-1 whereas the binding to neuropilin-1 of VEGF-B186 is regulated by proteolysis. In some embodiments, the peptide for treatment includes VEGF-B. In some embodiments, VEGF-B includes SEQ ID NO: 88 or SEQ ID NO: 89.

VEGF-C is a growth factor active in angiogenesis, and endothelial cell growth, stimulating their proliferation and migration and also has effects on the permeability of blood vessels. VEGF-C can function in angiogenesis of the venous and lymphatic vascular systems during embryogenesis, and also in the maintenance of differentiated lymphatic endothelium in adults. VEGF-C can bind and activate VEGFR-2 (KDR/FLK1) and VEGFR-3 (FLT4) receptors. In some embodiments, the peptide for treatment includes VEGF-C. In some embodiments, VEGF-C includes SEQ ID NO: 90.

VEGF-D (c-Fos-induced growth factor, or FIGF) is a growth factor active in angiogenesis, lymphangiogenesis and endothelial cell growth, stimulating their proliferation and migration and also has effects on the permeability of blood vessels. VEGF-D can function in the formation of the venous and lymphatic vascular systems during embryogenesis, and also in the maintenance of differentiated lymphatic endothelium in adults. VEGF-D can bind and activate VEGFR-2 (KDR/FLK1) and VEGFR-3 (FLT4) receptors. In some embodiments, the peptide for treatment includes VEGF-D. In some embodiments, VEGF-D includes SEQ ID NO: 91.

Placental growth factor (PGF) is a member of the VEGF family, and can play a role in angiogenesis and vasculogenesis, during embryogenesis. PGF is active in angiogenesis and endothelial cell growth, stimulating their proliferation and migration. It binds to the receptor FLT1/VEGFR-1. Isoform PIGF-2 binds NRP1/neuropilin-1 and NRP2/neuropilin-2 in a heparin-dependent manner. PFG can also promote cell tumor growth. PGF can be used for general cosmesis, to cause more youthful skin by attracting fibroblasts, and causing them to produce extracellular matrix, and leading to thicker, more youthful skin. In some embodiments the peptide for treatment includes PGF. In some embodiments, PGF includes SEQ ID NO: 92.

Platelet-derived growth factor subunit A (PDGFA) plays an essential role in the regulation of embryonic development, cell proliferation, cell migration, survival and chemotaxis. PDGFA is a potent mitogen for cells of mesenchymal origin. PDGFA is required for normal lung alveolar septum formation during embryogenesis, normal development of the gastrointestinal tract, normal development of Leydig cells and spermatogenesis. PDGFA is required for normal oligodendrocyte development and normal myelination in the spinal cord and cerebellum. PDGFA plays an important role in wound healing. Signaling can also be modulated by the formation of heterodimers with PDGFB. PDGFA can be used for general cosmesis, to cause more youthful skin by attracting fibroblasts, and causing them to produce extracellular matrix, and leading to thicker, more youthful skin. In some embodiments, the peptide for treatment includes PDGFA. In some embodiments, PDGFA includes SEQ ID NO: 93 or SEQ ID NO: 94.

Platelet-derived growth factor subunit B (PDGFB) plays an essential role in the regulation of embryonic development, cell proliferation, cell migration, survival and chemotaxis. PDGFB is a potent mitogen for cells of mesenchymal origin. PDGFB is required for normal proliferation and recruitment of pericytes and vascular smooth muscle cells in the central nervous system, skin, lung, heart and placenta. PDGFB is required for normal blood vessel development, and for normal development of kidney glomeruli. PDGFB plays an important role in wound healing. Signaling can also be modulated by the formation of heterodimers of PDGFB with PDGFA. PDGFB can be used for general cosmesis, to cause more youthful skin by attracting fibroblasts, and causing them to produce extracellular matrix, and leading to thicker, more youthful skin. In some embodiments, the peptide for treatment includes PDGFB. In some embodiments, PDGFB includes SEQ ID NO: 95 or SEQ ID NO: 96.

Platelet-derived Growth Factor C (PDGFC) plays an essential role in the regulation of embryonic development, cell proliferation, cell migration, survival and chemotaxis. PDGFC is a potent mitogen and chemo-attractant for cells of mesenchymal origin. PDGFC is required for normal skeleton formation during embryonic development, especially for normal development of the craniofacial skeleton and for normal development of the palate. PDGFC is required for normal skin morphogenesis during embryonic development. PDGFC plays an important role in wound healing, where it appears to be involved in three stages: inflammation, proliferation and remodeling. PDGFC plays an important role in angiogenesis and blood vessel development and is involved in fibrotic processes, in which transformation of interstitial fibroblasts into myofibroblasts plus collagen deposition occurs. The CUB domain of PDGFC has a mitogenic activity in coronary artery smooth muscle cells, suggesting a role beyond the maintenance of the latency of the PDGF domain. In the nucleus, PDGFC seems to have additional function. PDGFC can be used for general cosmesis, to cause more youthful skin by attracting fibroblasts, and causing them to produce extracellular matrix, and leading to thicker, more youthful skin. In some embodiments, the peptide for treatment includes PDGFC. In some embodiments, PDGFC includes or SEQ ID NO: 97, SEQ ID NO: 98, SEQ ID NO: 99, or SEQ ID NO: 100.

Platelet-derived Growth Factor D (PDGFD) plays an essential role in the regulation of embryonic development, cell proliferation, cell migration, survival and chemotaxis. PDGFD is a potent mitogen for cells of mesenchymal origin. PDGFD plays an important role in wound healing. PDGFD induces macrophage recruitment, increased interstitial pressure, and blood vessel maturation during angiogenesis. PDGFD can initiate events that lead to a mesangial proliferative glomerulonephritis, including influx of monocytes and macrophages and production of extracellular matrix. PDGFD can be used for general cosmesis, to cause more youthful skin by attracting fibroblasts, and causing them to produce extracellular matrix, and leading to thicker, more youthful skin. In some embodiments, the peptide for treatment includes PDGFD. In some embodiments, PDGFB includes SEQ ID NO: 101 or SEQ ID NO: 102.

The gene for Epidermal Growth Factor (EGF) encodes a member of the epidermal growth factor superfamily. The encoded protein is synthesized as a large precursor molecule that is proteolytically cleaved to generate the 53-amino acid epidermal growth factor peptide. This protein acts a potent mitogenic factor that plays an important role in the growth, proliferation and differentiation of numerous cell types. This protein acts by binding the high affinity cell surface receptor, epidermal growth factor receptor. Defects in this gene are the cause of hypomagnesemia type 4. Dysregulation of this gene has been associated with the growth and progression of certain cancers. Alternate splicing results in multiple transcript variants and isoforms. Pro-EGF can be used for general cosmesis, to cause more youthful skin by attracting fibroblasts, and causing them to produce extracellular matrix, and leading to thicker, more youthful skin. In some embodiments, the peptide for treatment includes Pro-EGF. Pro-EGF can have isoforms due to alternative splicing. In some embodiments, Pro-EGF includes SEQ ID NO: 103, SEQ ID NO: 104, SEQ ID NO: 105 or SEQ ID NO: 106.

Fibroblast Growth Factor (FGF) plays an important role in the regulation of cell survival, cell division, angiogenesis, cell differentiation and cell migration. FGF can function as potent mitogen in vitro. FGF can be used for general cosmesis, to cause more youthful skin by attracting fibroblasts, and causing them to produce extracellular matrix, and leading to thicker, more youthful skin. There are 22 different isoforms of FGF.

In some embodiments, the peptide for treatment includes FGF1. In some embodiments, FGF1 includes SEQ ID NO: 107 or SEQ ID NO: 108.

FGF2 has 4 isoforms produced by alternative initiation. FGF2 plays an important role in the regulation of cell survival, cell division, angiogenesis, cell differentiation and cell migration. FGF2 functions as potent mitogen in vitro. In some embodiments, the peptide for treatment includes FGF2. In some embodiments, FGF2 includes SEQ ID NO: 109, SEQ ID NO: 110, SEQ ID NO: 111, or SEQ ID NO: 112.

FGF3 has 1 isoform, and plays an important role in the regulation of embryonic development, cell proliferation, and cell differentiation. FGF3 is required for normal ear development. In some embodiments, the peptide for treatment includes FGF3. In some embodiments, FGF3 includes SEQ ID NO: 113.

FGF4 can have two isoforms due to alternative splicing. FGF4 plays an important role in the regulation of cell survival, cell division, angiogenesis, cell differentiation and cell migration. FGF4 can functions as potent mitogen in vitro. In some embodiments, the peptide for treatment includes FGF4. In some embodiments, FGF4 includes SEQ ID NO: 114 or SEQ ID NO: 115.

FGF5 can have two isoforms due to alternative splicing. FGF5 can play an important role in the regulation of cell proliferation and cell differentiation. FGF5 is required for normal regulation of the hair growth cycle. FGF5 can function as an inhibitor of hair elongation by promoting progression from anagen, the growth phase of the hair follicle, into catagen, the apoptosis-induced regression phase. In some embodiments, the peptide for treatment includes FGF5. In some embodiments, FGF5 includes SEQ ID NO: 116 or SEQ ID NO: 117.

The FGF6 isoform plays an important role in the regulation of cell proliferation, cell differentiation, angiogenesis and myogenesis, and is required for normal muscle regeneration. In some embodiments, the peptide for treatment includes FGF6. In some embodiments, FGF6 includes SEQ ID NO: 118.

FGF7 (Keratinocyte Growth Factor, KGF) has one isoform and plays an important role in the regulation of embryonic development, cell proliferation and cell differentiation. FGF7 is required for normal branching morphogenesis. The growth factor is particularly active upon keratinocytes. FGF7 is a possible major paracrine effector of normal epithelial cell proliferation. In some embodiments, the peptide for treatment includes FGF7. In some embodiments, FGF7 includes SEQ ID NO: 119.

FGF8 has four isoforms due to alternative splicing and plays an important role in the regulation of embryonic development, cell proliferation, cell differentiation and cell migration. FGF8 is required for normal brain, eye, ear, and limb development during embryogenesis. FGF8 is required for normal development of the gonadotropin-releasing hormone (GnRH) neuronal system. In some embodiments, the peptide for treatment includes FGF8. In some embodiments, FGF8 includes, SEQ ID NO: 120, SEQ ID NO: 121, SEQ ID NO: 122, or SEQ ID NO: 123.

FGF9 has one isoform and plays an important role in the regulation of embryonic development, cell proliferation, cell differentiation and cell migration. FGF9 can have a role in glial cell growth and differentiation during development, gliosis during repair and regeneration of brain tissue after damage, differentiation and survival of neuronal cells, and growth stimulation of glial tumors. In some embodiments, the peptide for treatment includes FGF9. In some embodiments, FGF9 includes SEQ ID NO: 124.

FGF10 (KGF2) has one isoform, and plays an important role in the regulation of embryonic development, cell proliferation and cell differentiation. FGF10 is required for normal branching morphogenesis. FGF10 can play a role in wound healing. In some embodiments, the peptide for treatment includes FGF10. In some embodiments, FGF10 includes SEQ ID NO: 125.

FGF11 has one isoform and is involved in nervous system development and function. In some embodiments, the peptide for treatment includes FGF11. In some embodiments, FGF11 includes SEQ ID NO: 126.

FGF12 has two isoforms due to alternative splicing and is involved in nervous system development and function. In some embodiments, the peptide for treatment includes FGF12. In some embodiments, FGF12 includes SEQ ID NO: 127 or SEQ ID NO: 128.

FGF13 has 5 isoforms produced by alternative splicing. FGF13 is a microtubule-binding protein which directly binds tubulin and is involved in both polymerization and stabilization of microtubules. Through its action on microtubules, FGF13 can participate in the refinement of axons by negatively regulating axonal and leading processes branching. FGF13 plays a crucial role in neuron polarization and migration in the cerebral cortex and the hippocampus. In some embodiments, the peptide for treatment includes FGF13. In some embodiments, FGF13 includes or SEQ ID NO: 129, SEQ ID NO: 130, SEQ ID NO: 131, SEQ ID NO: 132, or SEQ ID NO: 133.

FGF14 has two isoforms produced by alternative splicing and is involved in nervous system development and function. In some embodiments, the peptide for treatment includes FGF14. In some embodiments, FGF14 includes SEQ ID NO: 134 or SEQ ID NO: 135.

FGF16 has one isoform and plays an important role in the regulation of embryonic development, cell proliferation and cell differentiation, and is required for normal cardiomyocyte proliferation and heart development. In some embodiments, the peptide for treatment includes FGF16. In some embodiments, FGF16 includes SEQ ID NO: 136.

FGF17 has two isoforms due to alternate splicing and plays an important role in the regulation of embryonic development and as signaling molecule in the induction and patterning of the embryonic brain. FGF17 is required for normal brain development. In some embodiments, the peptide for treatment includes FGF17. In some embodiments, FGF17 includes SEQ ID NO: 137 or SEQ ID NO: 138.

FGF18 has one isoform and plays an important role in the regulation of cell proliferation, cell differentiation and cell migration. FGF18 is required for normal ossification and bone development. FGF18 stimulates hepatic and intestinal proliferation. In some embodiments, the peptide for treatment includes FGF18. In some embodiments, FGF18 includes SEQ ID NO: 139.

FGF19 has one isoform and is involved in the suppression of bile acid biosynthesis through down-regulation of CYP7A1 expression, following positive regulation of the JNK and ERK1/2 cascades. FGF19 stimulates glucose uptake in adipocytes. The activity of FGF19 requires the presence of KLB and FGFR4. In some embodiments, the peptide for treatment includes FGF19. In some embodiments, FGF19 includes SEQ ID NO: 140.

FGF20 has one isoform and plays as role as a neurotrophic factor that regulates central nervous development and function. In some embodiments, the peptide for treatment includes FGF20. In some embodiments, FGF20 includes SEQ ID NO: 141.

FGF21 has one isoform and stimulates glucose uptake in differentiated adipocytes via the induction of glucose transporter SLC2A1/GLUT1 expression (but not SLC2A4/GLUT4 expression). The activity of FGF21 requires the presence of KLB. In some embodiments, the peptide for treatment includes FGF21. In some embodiments, FGF21 includes SEQ ID NO: 142.

FGF22 has one isoform and plays a role in the fasting response, glucose homeostasis, lipolysis and lipogenesis. FGF22 can stimulate cell proliferation in vitro, and can be involved in hair development. In some embodiments, a cell secreting FGF22 can be used to treat alopecia. In some embodiments, the peptide for treatment includes FGF22. In some embodiments, FGF22 includes SEQ ID NO: 143.

FGF23 has one isoform and is a regulator of phosphate homeostasis. FGF23 inhibits renal tubular phosphate transport by reducing SLC34A1 levels and can upregulate EGR1 expression in the presence of KL. FGF23 acts directly on the parathyroid to decrease PTH secretion. FGF23 is also a regulator of vitamin-D metabolism and can negatively regulates osteoblast differentiation and matrix mineralization. In some embodiments, the peptide for treatment includes FGF23. In some embodiments, FGF23 includes SEQ ID NO: 144.

Hormones are a class of regulatory biochemicals that are produced in all organisms by glands, and transported by the circulatory system to distant target organs to coordinate its physiology, function, and behavior. Hormones can serve as a major form of communication between different organs and tissues. Hormones regulate a variety of physiological and behavioral activities, including digestion, metabolism, respiration, tissue function, sensory perception, sleep, perception, stress, growth and development, movement, and reproduction. In some embodiments, the peptide for treatment includes a hormone. Hormones can be used by subjects suffering from disease that is contributed by low hormone production in a subject. In certain embodiments a bacterium is genetically modified by introduction of a nucleic acid that encodes a hormone (e.g., a mammalian hormone). In certain embodiments a bacterium is genetically modified to express and/or secrete a hormone (e.g., a mammalian hormone).

In certain embodiments a hormone is a somatotrophin. In certain embodiments a hormone is a mammalian somatotrophin. In certain embodiments a hormone is a bovine or human somatotrophin. In certain embodiments a somatotrophin is growth hormone (GH).

Somatotrophin is a hormone that plays an important role in growth control. Its major role in stimulating body growth is to stimulate the liver and other tissues to secrete IGF-1. It stimulates both the differentiation and proliferation of myoblasts. It also stimulates amino acid uptake and protein synthesis in muscle and other tissues. In some embodiments the peptide for treatment includes somatotrophin. In some embodiments, the somatotrophin includes SEQ ID NO: 45, SEQ ID NO: 46, SEQ ID NO: 47, SEQ ID NO: 48 or SEQ ID NO: 49. Somatotrophin can be used by subjects suffering from low human growth hormone (HGH) production or subjects suffering from low testosterone production. In some embodiments, a cell including a nucleic acid for expressing a peptide includes an amino acid sequence for somatotrophin. As microbes can have the benefit of having the ability to get beneath the horny layer of the dermis and into the pores, the skin would have a better and increased opportunity to absorb these topicals than if the molecules themselves were applied topically by a lotion or a cream. One benefit of delivering a microbe-produced hormone to a subject in need is that such a method reduces the risk of exposure of the hormone to other subjects. As, in some embodiments, a genetically modified microbe is often engineered to depend on essential nutrients provide only to a subject in need. Therefore, delivery of a microbe-produced hormone to a subject in need can be safer than other methods of providing topical hormones which can often result in unwanted transfer to other subjects.

Anti-inflammatories are substances or treatments that reduce inflammation. Interleukins (IL) are a group of cytokines that can function as signaling molecules and act as an anti-inflammatory. Anti-inflammatories can be used by subjects in need suffering from an inflammatory disorder, such as acne. Microbes secreting anti-inflammatories have an advantage over creams containing anti-inflammatories, as microbes have the benefit of having the ability to get beneath the horny layer of the dermis and into the pores, increasing the opportunity to absorb these anti-inflammatories.

In some embodiments a microbe is genetically modified to express and/or secrete an anti-inflammatory. In certain embodiments an anti-inflammatory is a cytokine. In some embodiments, the genetically modified microbe secretes a cytokine. Non-limiting examples of cytokines include IL-4, IL-6, IL-7, IL-8, IL-10 and IL-13. In certain embodiments a bacterium is genetically modified by introduction of a nucleic acid that encodes one or more cytokines (e.g., a mammalian cytokines). A nucleic acid that encodes a cytokine may include a suitable promoter and/or regulatory elements that drive the transcription and/or translation (e.g., expression) of the cytokine, an open reading frame that encodes the cytokine and, in some embodiments, suitable nucleic acid and/or peptide elements that direct microbial secretion of the cytokine. In certain embodiments a bacterium is genetically modified by introduction of two or more nucleic acids that encode two or more cytokines (e.g., a mammalian cytokines). In certain embodiments a bacterium is genetically modified by introduction of a nucleic acid that directs the expression of one or more cytokines (e.g., a mammalian cytokines). In certain embodiments a bacterium is genetically modified to express and/or secrete a cytokine (e.g., a mammalian cytokine).

Interleukin 4 (IL-4) can participate in at least several B-cell activation processes as well as of other cell types. It is a co-stimulator of DNA-synthesis. It induces the expression of class II MHC molecules on resting B-cells. It enhances both secretion and cell surface expression of IgE and IgG1. It also regulates the expression of the low affinity Fc receptor for IgE (CD23) on both lymphocytes and monocytes. In some embodiments, the peptide for treatment includes interleukin 4 or a portion thereof. In some embodiments, the interleukin 4 includes SEQ ID NO: 24.

Interleukin 10 (IL-10) can inhibits the synthesis of a number of cytokines, including IFN-gamma, IL-2, IL-3, TNF and GM-CSF produced by activated macrophages and by helper T-cells. In some embodiments, the peptide for treatment includes interleukin 10 or a portion thereof. In some embodiments, the Interleukin 10 includes SEQ ID NO: 25.

Interleukin 13 (IL-13) is a cytokine that inhibits inflammatory cytokine production. Interleukin 13 synergizes with Interleukin 2 (IL2) in regulating interferon-gamma synthesis. Interleukin 13 can be critical in regulating inflammatory and immune responses. In some embodiments, the peptide for treatment includes Interleukin 13, or a portion thereof. In some embodiments, the interleukin 13 includes SEQ ID NO: 26.

Interleukin-1 receptor type 2 (IL1R2) is a non-signaling receptor for IL1A, IL1B and IL1RN. IL1R2 reduces IL1B activities. In certain embodiments a bacterium is genetically modified to express and/or secrete an IL1R2. IL1R2 can serve as a decoy receptor by competitive binding to IL1B and preventing its binding to IL1R1. IL1R2 can also modulate cellular response through non-signaling association with IL1RAP after binding to IL1B. IL1R2 (membrane and secreted forms) preferentially binds IL1A and poorly IL1A and IL1RN. The secreted IL1R2 recruits secreted IL1RAP with high affinity; this complex formation can be the dominant mechanism for neutralization of IL1B by secreted/soluble receptors. In some embodiments, the peptide for treatment includes IL1R2, or a portion thereof. In some embodiments, the interleukin 13 includes SEQ ID NO: 27 or SEQ ID NO: 28.

In some embodiments a microbe is genetically modified to express and/or secrete a vasodilator. In certain embodiments the genetically modified microbe secretes a vasodilator. Non-limiting examples of vasodilators include bradykinin.

In some embodiments a microbe is genetically modified to express and/or secrete an interleukin-1 receptor (IL-1R) antagonist. In certain embodiments an IL-1R antagonist is a protein or subsequence that binds to IL-1R. In some embodiments, the genetically modified microbe secretes an IL-1R antagonist. Non-limiting examples of IL-1R antagonists include Isoform 1, Isoform-2, Isoform-3 or Isoform-4.

Hyaluronic acid or HA/Hyaluronan is a biomolecule that is synthesized by a class of integral membrane proteins called hyaluronan synthases, of which vertebrates have three types: HAS1, HAS2, and HAS3. It is an anionic, glycosaminoglycan distributed widely throughout connective, epithelial, and neural tissues. Hyaluronic acid is non-sulfated, and forms in the plasma membrane instead of the Golgi, and can be very large, with a molecular weight often reaching the millions (in kDa). One of the chief components of the extracellular matrix, hyaluronan contributes significantly to cell proliferation and migration, and can also be involved in the progression of some malignant tumors.

HAS1 catalyzes the addition of GlcNAc or GlcUA monosaccharides to a nascent hyaluronan polymer. It is essential in hyaluronan synthesis, since hyaluronic acid is a major component of most extracellular matrices that has a structural role in tissues architectures and regulates cell adhesion, migration and differentiation. HAS1 is one of the isozymes catalyzing the reaction of the addition of GlcNAc or GlcUA monosaccharides to hyaluronan polymers. HAS1 is also able to catalyze the synthesis of chito-oligosaccharide depending on the substrate. HAS2 catalyzes the addition of GlcNAc or GlcUA monosaccharides to a nascent hyaluronan polymer. HAS2 is one of the isozymes that catalyzes this reaction and it is particularly responsible for the synthesis of high molecular mass hyaluronan. HAS 2 is required for the transition of endocardial cushion cells into mesenchymal cells, a process crucial for heart development. HAS2 can also play a role in vasculogenesis. High molecular mass hyaluronan can also play a role in early contact inhibition, a process which stops cell growth when cells come into contact with each other or the extracellular matrix. HAS3 catalyzes the addition of GlcNAc or GlcUA monosaccharides to the nascent hyaluronan polymer.

As a treatment, dry, scaly skin also known as xerosis such as that caused by atopic dermatitis or eczema can be treated with a prescription skin lotion containing sodium hyaluronate as its active ingredient. In several embodiments described herein, a nucleic acid encoding hyaluronan synthases or portion thereof is provided. In several embodiments, a cell can carry a nucleic acid encoding hyaluronan synthases or portion thereof. In some embodiments, the hyaluron synthases includes HAS1 (SEQ ID NO: 1) HAS2 (SEQ ID NO: 2), HAS3 isoform 1 (SEQ ID NO: 3), or HAS3 isoform 2 (SEQ ID NO: 4). Hyaluronic acid can be used for general cosmesis, plumping of the skin to reduce wrinkles. In some embodiments, the cell carrying a nucleic acid encoding hyaluronan synthases or portion thereof can lead to production of hyaluronic acid. In several embodiments, the peptide for treatment can be used for general cosmesis. As the cell can propagate and localize in pores and follicles, the absorption of hyaluronic acid is increased compared to topically applied lotions containing hyaluronic acid. In some embodiments, a subject in need suffering from xerosis is administered a topical formulation including a cell having a nucleic acid encoding hyaluronan synthases or portion thereof.

Elastin is a major structural protein of tissues such as aorta and nuchal ligament, which must expand rapidly and recover completely. Elastin is a molecular determinant of late arterial morphogenesis, it can also stabilize arterial structure by regulating proliferation and organization of vascular smooth muscle. Elastin can be used to contribute to skin elasticity as it can be readily absorbed by the skin. In some embodiments, the peptide for treatment includes elastin or a portion thereof. As microbes can have the benefit of having the ability to get beneath the horny layer of the dermis and into the pores, the skin would have a better and increased opportunity to absorb elastin from bacteria than if the elastin was applied topically through a lotion or a cream.

In some embodiments, the elastin, or portion thereof includes SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, or SEQ ID NO: 17.

Collagen is a main structural protein of the various connective tissues in animals. Collagen, in the form of elongated fibrils, is can be found in fibrous tissues, tendons, ligaments, skin, and is also abundant in corneas, cartilage, bones, blood vessels, the gut, and intervertebral discs. Collagen is created mostly from the fibroblast. Collagen is composed of a triple helix, consisting of two identical a1 chains and an additional chain that can differ in chemical composition. The amino acid composition of collagen can have high hydroxyproline content. In some embodiments, the peptide of treatment includes collagen or a portion thereof. Collagen can be absorbed by the skin to add to the extracellular matrix, and the dermal thickness. As microbes can have the benefit of having the ability to get beneath the horny layer of the dermis and into the pores, the skin would have a better and increased opportunity to absorb the collagen than if the molecules themselves were applied topically by a lotion or a cream. In some embodiments, peptide of treatment including collagen or a portion thereof includes SEQ ID NO: 18, SEQ ID NO: 19, SEQ ID NO: 20, SEQ ID NO: 21, SEQ ID NO: 22 or SEQ ID NO: 23.

Clotting factors as described herein, refers to chemical and cellular constituents that can cause the blood to coagulate or clot. Blood clotting factors can be used externally by a subject in need suffering from hemophilia, or by a subject under treatment of a blood thinner. Blood thinners can include fish oil, aspirin, anti-platelet drugs, and other types of anticoagulants. Anti-coagulants can include but is not limited to antithrombics, fibrinolytic, and thrombolytics.

Coagulation Factor VIII is a member of the multi-copper oxidase family. Coagulation Factor VIII is a cofactor for factor IXa which, in the presence of $Ca+^2$ and phospholipids, converts factor X to an activated form, Xa. Coagulation Factor VIII is a coagulation cofactor which circulates bound to von Willebrand factor and is part of the intrinsic coagulation pathway. It is a macromolecular complex composed of two separate entities, one of which, when deficient, results in hemophilia A, and the other, when deficient, results in von Willebrand's disease. Hemophilia A is a disorder of blood coagulation characterized by a permanent tendency to hemorrhage. In some embodiments, the peptide for treatment includes coagulation factor VIII. In some embodiments, the coagulation factor VIII includes SEQ ID NO: 29 or SEQ ID NO: 30. In some embodiments, the peptide for treatment includes coagulation factor VIII heavy chain in a 200 kDa isoform. In some embodiments, the coagulation factor VIII heavy chain in a 200 kDa includes SEQ ID NO: 31. In some embodiments, the peptide for treatment includes coagulation factor VIII heavy chain in a 92 kDa isoform. In some embodiments, the coagulation factor VIII heavy chain in a 92 kDa includes SEQ ID NO: 32. In some embodiments, the peptide for treatment includes coagulation factor VIII B chain. In some embodiments, the coagulation factor VIII B chain includes SEQ ID NO: 33. In some embodiments, the peptide for treatment includes coagulation factor VIIa light chain. In some embodiments, the coagulation factor VIIa light chain includes SEQ ID NO: 34.

Factor IX is a vitamin K-dependent plasma protein that participates in the intrinsic pathway of blood coagulation by converting factor X to its active form in the presence of Ca2+ ions, phospholipids, and factor VIIa. In some embodiments, the peptide for treatment is Factor IX. In some embodiments, the Factor IV includes SEQ ID NO: 35, SEQ ID NO: 36, SEQ ID NO: 37, SEQ ID NO: 38 or SEQ ID NO: 39.

Melanin in the skin is produced by melanocytes, found in the basal layer of the epidermis. Although, in general, human beings possess a similar concentration of melanocytes in their skin, the melanocytes in some individuals and ethnic groups more frequently or less frequently express the melanin-producing genes, thereby conferring a greater or lesser concentration of skin melanin.

Tyrosinase is an oxidase, the rate-limiting enzyme for controlling the production of melanin. Tyrosinase is involved in the hydroxylation of a monophenol and the conversion of an o-diphenol to the corresponding o-quinone. o-Quinone undergoes several reactions to eventually form melanin. In some embodiments, the peptide for treatment is produced by tyrosinase, or fragment thereof. In some embodiments, the tyrosinase includes SEQ ID NO: 40, SEQ ID NO: 41, SEQ ID NO: 42, SEQ ID NO: 43 or SEQ ID NO: 44. In some embodiments, cells can include, for example, a nucleic acid encoding tyrosinase, or fragment thereof. In some embodiments, the microbes produce tyrosinase for the enzymatic production of melanin. As microbes can have the benefit of having the ability to get beneath the horny layer of the dermis and into the pores, the skin would have a better and increased opportunity to absorb these topicals than if the molecules themselves were applied topically by a lotion or a cream. The production of melanin can be used for "sunless" tanning in order to increase the melanin in a subject.

Chemokines are a family of small cytokines that are secreted by cells as signaling molecules. Proteins classified as chemokines are small in size (8-10 KDa in size), and have four conserved cysteine residues in conserved locations, forming a conserved 3-dimensional shape among the chemokines. Chemokines can be considered pro-inflammatory and can be induced during an immune response to recruit cells of the immune system to a site of infection, while others are considered homeostatic and are involved in controlling the migration of cells during normal processes of tissue maintenance or development. Chemokines are found in all vertebrates, some viruses and some bacteria, but none have been described for other invertebrates. In some embodiments, the peptide for treatment includes a chemokine.

Platelet basic protein (LA-PF4) belongs to the chemokine family. LA-PF4 stimulates DNA synthesis, mitosis, glycolysis, intracellular cAMP accumulation, prostaglandin E2 secretion, and synthesis of hyaluronic acid and sulfated glycosaminoglycan. It also stimulates the formation and secretion of plasminogen activator by human synovial cells. NAP-2 is a ligand for CXCR1 and CXCR2, and NAP-2, NAP-2(73), NAP-2(74), NAP-2(1-66), and most potent NAP-2(1-63) are chemo-attractants and activators for neutrophils. TC-1 and TC-2 are antibacterial proteins, in vitro released from activated platelet alpha-granules. CTAP-III (1-81) is more potent than CTAP-III desensitizes chemokine-induced neutrophil activation. LA-PF4 can be used for general cosmesis, to cause more youthful skin by attracting fibroblasts, and causing them to produce extracellular matrix, and leading to thicker, more youthful skin. In some embodiments the peptide for treatment includes platelet basic protein. In some embodiments, the platelet basic protein includes SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61 or SEQ ID NO: 62.

DNA repair enzymes are used for the repair of DNA damaged by reactive oxygen species, replication errors, exogenous damage caused by external agents such as ultraviolet rays, toxins, mutagenic chemicals, DNA intercalating agents, and viruses. There are several types of damage which can be oxidation of bases, alkylation of bases, deamination, depurination, mismatch of bases, monoadduct damage, and diadduct damage. DNA repair enzymes can be used for anti-aging, and reversal of DNA damage via solar damage/radiation.

Base excision repair (BER) is a mechanism that repairs damaged DNA during the cell cycle, removing small non-helix distorting base lesions from the genome. BER is very important as it removes damaged bases that could lead to mutations by mispairing or lead to breaks in the DNA during replication. The process is initiated by DNA glycosylases, which can recognize and remove damaged or inappropriate bases, forming AP sites. The AP sites are then cleaved by an AP endonuclease resulting in a single strand break that can then be processed by a short or a long patch repair process.

In some embodiments, the peptide for treatment includes base excision repair (BER) enzymes. In some embodiments, BER enzymes includes SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, or SEQ ID NO: 155.

Direct reversal of DNA damage is another repair mechanism to restore damaged DNA. The formation of pyrimidine dimers, is the major type of damage that is caused by UV light. The damage distorts the DNA double helix and blocks transcription or replication past the damaged site. In some embodiments, the peptide for treatment includes enzymes for the direct reversal of DNA damage. In some embodiments, the enzymes for the direct reversal of DNA damage includes SEQ ID NO: 156, SEQ ID NO: 157, or SEQ ID NO: 158.

DNA mismatch repair proteins are involved in the recognition and repairing of nucleic acid which have erroneous insertions, deletions, and misincorporation of bases that can stem from the processes of DNA replication and recombination, and from DNA damage. In some embodiments, the peptide for treatment includes enzymes for DNA mismatch repair. In some embodiments, the enzymes for DNA mismatch repair includes SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, or SEQ ID NO: 168.

Nucleotide excision repair (NER) is a DNA repair mechanism that removes DNA damage that is caused by ultraviolet light. The damage of ultraviolet light can lead to DNA adducts which can consist of thymine dimers, and 6,4-photoproducts. The NER proteins recognize the damage leading to the removal of short single-stranded DNA segments that contain the lesion. The undamaged compliment is then used as a template by DNA polymerase to synthesize a short complementary sequence which is subsequently ligated by a DNA ligase. In some embodiments, the peptide for treatment includes enzymes for nucleotide excision repair. In some embodiments, the enzymes for nucleotide excision repair includes or SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, or SEQ ID NO: 197.

DNA editing and processing involve the use of several types of nucleases and are involved in DNA replication and repair. For example, DNase IV can remove the 5' overhanging flaps in DNA repair and processes the 5' ends of Okazaki fragments in lagging strand DNA synthesis. Direct physical interaction between this protein and AP endonuclease 1 during long-patch base excision repair provides coordinated loading of the proteins onto the substrate, thus passing the substrate from one enzyme to another. The protein is a member of the XPG/RAD2 endonuclease family and is one of ten proteins essential for cell-free DNA replication.

MTMR15, also known as myotubularin related protein is a DNA endo- and exonuclease involved in the repair of DNA damage caused by crosslinking agents. FAN1 is recruited to sites of interstrand cross linkage damage by interacting with the protein complex FANCI-FANCD2 complex. Together the proteins promote interstrand crosslink repair in a manner strictly dependent on its ability to accumulate at or near sites of DNA damage and that relies on monoubiquitylation of the FANCI-FANCD2 complex.

DNase III, or TREX1 is a major nuclear DNA-specific 3'-5' exonuclease that is widely distributed in both proliferating and nonproliferating mammalian tissues. DNase III translocates to the nucleus at S phase after DNA damage by gamma-irradiation or hydroxyurea. DNase III has a preference for single stranded DNA in repair.

TREX2 encodes for a 3'exonuclase. The encoded protein can participate in double stranded DNA break repair, and can interact with DNA polymerase delta. TREX2 can remove mismatched modified, fragmented, and normal nucleotides in order to generate the 3' termini for subsequent steps in the DNA metabolic pathway.

EXO1/HEX1 is an 803 amino acid human protein that functions in DNA replication, repair and recombination. EXO1/HEX1 can participate in mismatch-provoked excision directed by strand breaks located either 5-prime or 3-prime to the mispair.

Aprataxin (APTX) is another protein involved in editing and processing of DNA. APTX plays a role in single stranded DNA repair by removing AMP form DNA ends following ligation attempts of DNA ligase IV during non-homologous end joining.

SPO11 is an endonuclease of the editing and processing nucleases that functions during meiotic recombination. SPO11 produces double stranded breaks (DSB) in DNA, an important step during the meiotic recombination. In absence of SPO11, there is a failure to initiate the production of DSB which can lead to chromosomes segregating aberrantly which can result in aneuploidy gametes.

Endonuclease V (ENDOV) is a nuclease of the editing and processing nucleases, and is an endoribonuclease that specifically cleaves inosine-containing RNAs, at the second phosphodiester bond 3' to inosine. ENDOV has a strong preference for single-stranded RNAs (ssRNAs) toward double-stranded RNAs (dsRNAs). ENDOV cleaves mRNAs and tRNAs containing inosine. ENDOV is also able to cleave structure-specific dsRNA substrates containing the specific sites 5'-IIUI-3' and 5'-UIUU-3'. Inosine is present in a number of RNAs following editing; the function of inosine-specific endoribonuclease is still unclear. Inosine could either play a regulatory role in edited RNAs, or it can be involved in antiviral response by removing the hyperedited long viral dsRNA genome that has undergone A-to-I editing.

In some embodiments, the peptide for treatment includes editing and processing nucleases. In some embodiments, the enzymes for editing and processing includes SEQ ID NO: 198, SEQ ID NO: 199, SEQ ID NO: 200, SEQ ID NO: 201, SEQ ID NO: 202, SEQ ID NO: 203, SEQ ID NO: 204, or SEQ ID NO: 205.

Telomeres are regions at the tips of the chromosomes that get shorter during aging and during cell division, or mitosis. In order to repair the tips of the chromosomes, an enzyme, telomerase, repairs the tips which can have potential to repair age or disease related damage. Telomerase, is a ribonucleoprotein that adds DNA sequence repeats to the 3end of DNA in the telomeric regions (the ends of eukaryotic chromosomes). In some embodiments, the peptide for treatment comprises telomerase or a portion thereof. In some embodiments, the telomerase or portion thereof comprises SEQ ID NO: 206, SEQ ID NO: 207, SEQ ID NO: 208, or SEQ ID NO: 209.

Protection of telomeres protein 1 is encoded by POT1, a member of the telombin family and is involved in the maintenance of the telomere. POT1 functions by binding to the repeat of telomeres at the end of the eukaryotic chromosome, regulating the telomere length and protecting the chromosome ends from irregular recombination, instability, and abnormal chromosome instability. In several embodiments, the peptide for treatment comprises protection of telomeres protein 1 or a portion thereof. In some embodiments, the protection of telomeres protein 1 or portion thereof comprises SEQ ID NO: 210, or SEQ ID NO: 211.

In some embodiments, methods are described wherein the peptide for treatment comprises a fusion protein. In some embodiments, the fusion protein can comprise a first protein sequence comprising an amino acid sequence of elastin, collagen, an anti-inflammatory, clotting factor, hormone, platelet basic protein, transforming growth factor, hepatocyte growth factor, vascular endothelial growth factor, placental growth factor, platelet derived growth factor, epidermal growth factor, fibroblast growth factor, a DNA repair enzyme, a telomerase, or a protection of telomerase protein 1. In some embodiments, the fusion protein is fused to a second protein comprising an amino acid sequence of elastin, collagen, an anti-inflammatory, clotting factor, hormone, platelet basic protein, transforming growth factor, hepatocyte growth factor, vascular endothelial growth factor, placental growth factor, platelet derived growth factor, epidermal growth factor, fibroblast growth factor, a DNA repair enzyme, a telomerase, or a protection of telomerase protein 1, wherein the amino acid sequence of the second protein is not the amino acid sequence of the first protein. Fusion proteins can have the added benefit of introducing a second moiety to the peptide of treatment to treat a subject in need.

In several embodiments described herein, populations of genetically modified bacteria are created and/or derived from bacterial members from a group consisting of the genus *Propionibacterium*, Cornyebacterium, Staphylococus, *Streptococcus, Lactobacillus*, and *Lactococcus*. In some embodiments genetically modified bacteria are derived from the genus *Propionibacterium*. Non-limiting examples of species of *Propionibacterium* include *Propionibacterium acidifaciens, Propionibacterium acidipropionici, Propionibacterium acnes, Propionibacterium australiense, Propionibacterium avidum, Propionibacterium cyclohexanicum, Propionibacterium freudenreichii, Propionibacterium freudenreichii, Propionibacterium granulosum, Propionibacterium jensenii, Propionibacterium microaerophilum, Propionibacterium propionicum* and *Propionibacterium* thoeniiand.

In some embodiments a genetically modified bacteria is derived from the species *Propionibacterium acnes* (*P. acnes*). A genetically modified bacteria can be derived from a pathogenic or non-pathogenic strain of *P. acnes*. Recent studies have suggested that there are certain strains of *P. acnes* that are associated with pathogenicity and others that are associated with healthy skin (Fitz-Gibbon, S., et al., (2013) *Invest. Dermatol.*, 133(9):2152-60; Lomholt H B and Kilian M. (2010) *PLoS One*, 5(8):e12277; McDowell A, et al., (2011) *Microbiology* 157(Pt 7):1990-2003). Of the types thought to be associated with healthy skin, the Type II, ribotype 6 strain seems to have the lowest association with acne. Type II *P. acnes* contain a CRISPR array that confers immunity to *P. acnes*-specific phages and mobile genetic elements (Brüggemann H, et al., (2012) *PLoS ONE* 7(3): e34171). This seems to explain why the bacteria may be commensal in nature, as it cannot acquire pathogenic traits from other bacterium.

A genetically modified bacteria can be derived from any suitable microbiome of *P. acnes*, non-limiting examples of which include microbiomes of type I, type II, type III, type IV and type V. In certain embodiments a genetically modified bacterium is derived from a strain of *P. acnes* of a phenotype of type I (e.g., clades IA or type IB), type II or type III. A genetically modified bacteria can be derived from any suitable ribotype of *P. acnes*, non-limiting examples of which include ribotypes RT1 through RT30. In certain embodiments a genetically modified bacterium is derived from a *P. acnes* of ribotype RT1, RT2, RT3, RT4, RT5, RT6, RT7, RT8, RT9 or RT10. In certain embodiments a genetically modified bacterium is derived from a *P. acnes* of ribotype RT2 or RT6. VIn certain embodiments a genetically modified bacterium is derived from a *P. acnes* of strain Type II and ribotype RT2 or RT6.

A genetically unmodified bacteria can be derived from any suitable microbiome of *P. acnes*. In certain embodiments a genetically unmodified bacterium is derived from a *P. acnes* of ribotype RT1, RT2, RT3, RT4, RT5, RT6, RT7, RT8, RT9 or RT10. In certain embodiments a genetically unmodified bacterium is derived from a *P. acnes* of ribotype RT2 or RT6. In certain embodiments a genetically unmodified bacterium is derived from a *P. acnes* of strain Type II and ribotype RT2 or RT6.

In some embodiments a genetically modified bacterium is derived from a bacteria comprising a CRISPR (clustered regularly interspaced short palindromic repeat) locus, sometimes referred to as a CRISPR array (e.g., see Horvath and Barrangou (2010) *Science* 327:167-70; Makarova et al., (2011) *Nat Rev Microbiol* 9:467-77; and Brüggemann H, et al., (2012) *PLoS ONE* 7(3):e34171). Without being limited to theory, CRISPR arrays in bacteria such as *P. acnes* have been shown to confer protective "immunity" against invading genetic elements (e.g., viruses, phage and plasmids). Without being limited to theory, the presence of a CRISPR array can preserve the integrity of the genome of a genetically modified bacteria and prevent introduction of foreign genetic elements from other pathogenic strains of bacteria. Although a CRISPR array is thought to protect bacteria from the introduction of foreign genetic elements from other bacteria, phage and/or virus, bacteria containing a CRISPR array are amenable to transformation, stable integration of transformed DNA and integration of nucleic acid by homologous recombination. In some embodiments a genetically modified bacteria comprises an endogenous CRISPR array. For example, in some embodiments a genetically modified bacterium is derived from an RT2 or RT6 ribotype of *P. acnes*, each of which comprises an endogenous CRISPR array. In some embodiments a genetically modified bacteria comprises an exogenous CRISPR array introduced by genetic manipulation.

A genetically unmodified bacteria can also comprise an endogenous CRISPR array. For example, in some embodiments a genetically unmodified bacterium is derived from an RT2 or RT6 ribotype of *P. acnes*, each of which comprises an endogenous CRISPR array.

In some embodiments, the populations of modified bacteria are created from *Propionibacterium acnes*, or a strain thereof. In some embodiments, the populations of transformed bacteria are created from *Corynebacterium striatum*. In some embodiments, the populations of transformed bacteria are created from *Staphylococcus epidermis*. In some embodiments, the populations of transformed bacteria are created from *Streptococcus thermophilus*. In some embodiments, the populations of transformed bacteria are created from *Lactobacillus acidophilus*. In some embodiments, the populations of transformed bacteria are created from *Lactococcus lactis*. In some embodiments, the populations of transformed bacteria are created from the genus Enterococci. In some embodiments, the populations of transformed bacteria are created from the genus Micrococci. In some embodiments, the populations of transformed bacteria are created from the genus *Demodex*. In some embodiments, the populations of transformed bacteria are created from the genus *Malassezia*. In some embodiments, the populations of transformed bacteria are created from non-pathogenic Eschericia coli. In some embodiments, the populations of transformed bacteria are created from the genus Acidovorax. The populations of transformed bacteria are created from Acidovorax temperans. In some embodiments, the populations of transformed bacteria are created from the genus *Acinetobacter*. In some embodiments, the populations of transformed bacteria are created from *Acinetobacter haemolyticus*. In some embodiments, the populations of transformed bacteria are created from *Acinetobacter johnsonii*. In some embodiments, the populations of transformed bacteria are created from *Acinetobacter junii*. In some embodiments, the populations of transformed bacteria are created from *Acinetobacter ursingii*. In some embodiments, the populations of transformed bacteria are created from the genus *Actinomyces*. In some embodiments, the populations of transformed bacteria are created from *Actinomyces naeslundii*. In some embodiments, the populations of transformed bacteria are created from *Actinomyces neuii*. In some embodiments, the populations of transformed bacteria are created from the genus Anaerococcus. In some embodiments, the populations of transformed bacteria are created from *Anaerococcus prevotii*. In some embodiments, the populations of transformed bacteria are created from the genus Atopobium. In some embodiments, the populations of transformed bacteria are created from Atopobium vaginae. In some embodiments, the populations of transformed bacteria are created from the genus *Brevibacterium*. In some embodiments, the populations of transformed bacteria are created from *Brevibacterium paucivorans*. In some embodiments, the populations of transformed bacteria are created from the genus *Brevundimonas aurantiaca*. In some embodiments, the populations of transformed bacteria are created from *Brevundimonas aurantiaca*. In some embodiments, the populations of transformed bacteria are created from *Brevundimonas vesicularis*. In some embodiments, the populations of transformed bacteria are created from the genus Candidatus Nostocoida. In some embodiments, the populations of transformed bacteria are created from Candidatus Nostocoida *limicola*. In some embodiments, the populations of transformed bacteria are created from the genus *Corynebacterium*. In some embodiments, the populations of transformed bacteria are created from *Corynebacterium accolens*. In some embodiments, the populations of transformed bacteria are created from *Corynebacterium afermentans*. In some embodiments, the populations of transformed bacteria are created from *Corynebacterium amycolatum*. In some embodiments, the populations of transformed bacteria are created from *Corynebacterium appendicis*. In some embodiments, the populations of transformed bacteria are created from *Corynebacterium aurimucosum*. In some embodiments, the populations of transformed bacteria are created from *Corynebacterium coyleae*. In some embodiments, the populations of transformed bacteria are created from *Corynebacterium durum*. In some embodiments, the populations of transformed bacteria are created from *Corynebacterium glaucum*. In some embodiments, the populations of transformed bacteria are created from *Corynebacterium glucuronolyticum*. In some embodiments, the populations of transformed bacteria are created from *Corynebacterium imitans*. In some embodiments, the populations of transformed bacteria are created from *Corynebacterium jeikeium*. In some embodiments, the populations of transformed bacteria are created from *Corynebacterium kroppenstedtii*. In some embodiments, the populations of transformed bacteria are created from *Corynebacterium lipophiloflavum*. In some embodiments, the populations of transformed bacteria are created from *Corynebacterium matruchotii*. In some embodiments, the populations of transformed bacteria are created from *Corynebacterium minutissimum*. In some embodiments, the populations of transformed bacteria are created from *Corynebacterium mucifaciens*. In some embodiments, the populations of transformed bacteria are created from *Corynebacterium* pseudodiphthericum. In some embodiments, the populations of transformed bacteria are created from *Corynebacterium nigricans*. In some embodiments, the populations of transformed bacteria are created from *Corynebacterium* pseudodiphthericum. In some embodiments, the populations of transformed bacteria are created from *Corynebacterium simulans*. In some embodiments, the populations of transformed bacteria are created from *Corynebacterium singulare*. In some embodiments, the populations of transformed bacteria are created from *Corynebacterium sundsvallense*. In some embodiments, the populations of transformed bacteria are created from *Corynebacterium tuberculostearicum*. In some embodiments, the populations of transformed bacteria are created from the genus Diaphorobacter. In some embodiments, the populations of transformed bacteria are created from *Diaphorobacter nitroreducens*. In some embodiments, the populations of transformed bacteria are created from the genus Enhydrobacter. In some embodiments, the populations of transformed bacteria are created from *Enhydrobacter aerosaccus*. In some embodiments, the populations of transformed bacteria are created from the genus *Enterobacter*. In some embodiments, the populations of transformed bacteria are created from *Enterobacter asburiae*. In some embodiments, the populations of transformed bacteria are created from the genus *Enterococcus*. In some embodiments, the populations of transformed bacteria are created from *Enterococcus faecalis*. In some embodiments, the populations of transformed bacteria are created from the genus Eremococcus. In some embodiments, the populations of transformed bacteria are created from *Eremococcus coleocola*. In some embodiments, the populations of transformed bacteria are created from the genus Facklamia. In some embodiments, the populations of transformed bacteria are created from *Facklamia hominis*. In some embodiments, the populations of transformed bacteria are created from *Facklamia languida*. In some embodiments, the populations of transformed bacteria are created from the genus *Gardnerella*. In some embodiments, the populations of transformed bacteria are created from *Gardnerella vaginalis*. In some embodiments, the populations of transformed bacteria are created from the genus Gemella. In some embodiments, the populations of transformed bacteria are created from *Gemella haemolysans*. In some embodiments, the populations of transformed bacteria are created from *Gemella morbillorum*. In some embodiments, the populations of transformed bacteria are created from *Gemella sanguinis*. In some embodiments, the populations of transformed bacteria are created from the genus *Gordonia*. In some embodiments, the populations of transformed bacteria are created from *Gordonia. Bronchialis*. In some embodiments, the populations of transformed bacteria are created from *Gordonia. sputi*. In some embodiments, the populations of transformed bacteria are created from *Gordonia. terrae*. In some embodiments, the populations of transformed bacteria are created from the genus Granulicatella. In some embodiments, the populations of transformed bacteria are created from *Granulicatella elegans*. In some embodiments, the populations of transformed bacteria are created from the genus *Hyphomicrobium*. In some embodiments, the populations of transformed bacteria are created from *Hyphomicrobium facile*. In some embodiments, the populations of transformed bacteria are created from the genus Janibacter. In some embodiments, the populations of transformed bacteria are created from *Janibacter melonis*. In some embodiments, the populations of transformed bacteria are created from the genus *Kocuria*. In some embodiments, the populations of transformed bacteria are created from *Kocuria marina*. In some embodiments, the populations of transformed bacteria are created from *Kocuria palustris*. In some embodiments, the populations of transformed bacteria are created from *Kocuria rhizophila*. In some embodiments, the populations of transformed bacteria are created from the genus *Lactobacillus*. In some embodiments, the populations of transformed bacteria are created from *Lactobacillus* crispatus. In some embodiments, the populations of transformed bacteria are created from *Lactobacillus jensenii*. In some embodiments, the populations of transformed bacteria are created from the genus *Leuconostoc*. In some embodiments, the populations of transformed bacteria are created from *Leuconostoc argentinum*. In some embodiments, the populations of transformed bacteria are created from the genus *Methylobacterium*. In some embodiments, the populations of transformed bacteria are created from *Methylobacterium extorquens*. In some embodiments, the populations of transformed bacteria are created from *Methylobacterium mesophilicum*. In some embodiments, the populations of transformed bacteria are created from the genus *Micrococcus*. In some embodiments, the populations of transformed bacteria are created from *Micrococcus luteus*. In some embodiments, the populations of transformed bacteria are created from the genus Microlunatus. In some embodiments, the populations of transformed bacteria are created from *Microlunatus phosphovorus*. In some embodiments, the populations of transformed bacteria are created from the genus *Mobiluncus curtisii*. In some embodiments, the populations of transformed bacteria are created from *Mobiluncus curtisii* subsp. *holmesii*. In some embodiments, the populations of transformed bacteria are created from the genus *Mycobacterium*. In some embodiments, the populations of transformed bacteria are created from *Mycobacterium chlorophenolicum*. In some embodiments, the populations of transformed bacteria are created from *Mycobacterium obuense*. In some embodiments, the populations of transformed bacteria are created from the genus Nakamurella. In some embodiments, the populations of transformed bacteria are created from *Nakamurella multipartita*. In some embodiments, the populations of transformed bacteria are created from the genus Pedomicrobium. In some embodiments, the populations of transformed bacteria are created from *Pedomicrobium australicum*. In some embodiments, the populations of transformed bacteria are created from the genus Peptoniphilus. In some embodiments, the populations of transformed bacteria are created from *Peptoniphilus harei*. In some embodiments, the populations of transformed bacteria are created from the genus *Peptostreptococcus*. In some embodiments, the populations of transformed bacteria are created from *Peptostreptococcus anaerobius*. In some embodiments, the populations of transformed bacteria are created from the genus *Prevotella*. In some embodiments, the populations of transformed bacteria are created from *Prevotella bivia*. In some embodiments, the populations of transformed bacteria are created from *Prevotella corporis*. In some embodiments, the populations of transformed bacteria are created from *Prevotella disiens*. In some embodiments, the populations of transformed bacteria are created from *Prevotella melaninogenica*. In some embodiments, the populations of transformed bacteria are created from the genus *Propionibacterium*. In some embodiments, the populations of transformed bacteria are created from *Propionibacterium acnes*. In some embodiments, the populations of transformed bacteria are created from *Propionibacterium granulosum*. In some embodiments, the populations of transformed bacteria are created from the genus *Pseudomonas*. In some embodiments, the populations of transformed bacteria are created from *Pseudomonas aeruginosa*. In some embodiments, the populations of transformed bacteria are created from *Pseudomonas saccharophila*. In some embodiments, the populations of transformed bacteria are created from *Pseudomonas stutzeri*. In some embodiments, the populations of transformed bacteria are created from *Pseudomonas tremae*. In some embodiments, the populations of transformed bacteria are created from the genus *Rhodococcus*. In some embodiments, the populations of transformed bacteria are created from *Rhodococcus corynebacterioides*. In some embodiments, the populations of transformed bacteria are created from *Rhodococcus erythropolis*. In some embodiments, the populations of transformed bacteria are created from the genus *Rothia*. In some embodiments, the populations of transformed bacteria are created from *Rothia aeria*. In some embodiments, the populations of transformed bacteria are created from *Rothia*

*dentocariosa*. In some embodiments, the populations of transformed bacteria are created from *Rothia mucilaginosa*. In some embodiments, the populations of transformed bacteria are created from *Rothia nasimurium*. In some embodiments, the populations of transformed bacteria are created from the genus Serratia. In some embodiments, the populations of transformed bacteria are created from *Serratia liquefaciens*. In some embodiments, the populations of transformed bacteria are created from *Serratia marcescens* subsp. Sakuensis. In some embodiments, the populations of transformed bacteria are created from the genus Sphingobium. In some embodiments, the populations of transformed bacteria are created from *Sphingobium amiens*. In some embodiments, the populations of transformed bacteria are created from the genus *Staphylococcus*. In some embodiments, the populations of transformed bacteria are created from *Staphylococcus capitis*. In some embodiments, the populations of transformed bacteria are created from *Staphylococcus caprae*. In some embodiments, the populations of transformed bacteria are created from *Staphylococcus cohnii*. In some embodiments, the populations of transformed bacteria are created from *Staphylococcus epidermidis*. In some embodiments, the populations of transformed bacteria are created from *Staphylococcus haemolyticus*. In some embodiments, the populations of transformed bacteria are created from *Staphylococcus hominis*. In some embodiments, the populations of transformed bacteria are created from *Staphylococcus saccharolyticus*. In some embodiments, the populations of transformed bacteria are created from *Staphylococcus warneri*. In some embodiments, the populations of transformed bacteria are created from the genus *Stenotrophomonas*. In some embodiments, the populations of transformed bacteria are created from *Stenotrophomonas maltophilia*. In some embodiments, the populations of transformed bacteria are created from the genus *Streptococcus*. In some embodiments, the populations of transformed bacteria are created from *Streptococcus agalactiae*. In some embodiments, the populations of transformed bacteria are created from *Streptococcus cristatus*. In some embodiments, the populations of transformed bacteria are created from *Streptococcus gordonii*. In some embodiments, the populations of transformed bacteria are created from *Streptococcus infantis*. In some embodiments, the populations of transformed bacteria are created from *Streptococcus intermedius*. In some embodiments, the populations of transformed bacteria are created from *Streptococcus mitis*. In some embodiments, the populations of transformed bacteria are created from *Streptococcus parasanguinis*. In some embodiments, the populations of transformed bacteria are created from *Streptococcus parasanguinis*. In some embodiments, the populations of transformed bacteria are created from *Streptococcus salivarius*. In some embodiments, the populations of transformed bacteria are created from *Streptococcus sanguinis*. In some embodiments, the populations of transformed bacteria are created from the genus Tetrasphaera. In some embodiments, the populations of transformed bacteria are created from *Tetrasphaera elongata*. In some embodiments, the populations of transformed bacteria are created from the genus *Tsukamurella*. In some embodiments, the populations of transformed bacteria are created from *Tsukamurella tyrosinosolvens*. In some embodiments, the populations of transformed bacteria are created from the genus *Tsukamurella*. In some embodiments, the populations of transformed bacteria are created from the genus *Veillonella*. In some embodiments, the populations of transformed bacteria are created from *Veillonella parvula*. In some embodiments, the populations of transformed bacteria are created from *Veillonella parvula*. In some embodiments, the populations of transformed bacteria are created from Bradyrhizobiaceae U8776. In some embodiments, the populations of transformed bacteria are created from Carnobacterium AJ427446. In some embodiments, the populations of transformed bacteria are created from *Corynebacterium* AY581888. In some embodiments, the populations of transformed bacteria are created from *Corynebacterium* AF543288. In some embodiments, the populations of transformed bacteria are created from *Corynebacterium* X81872. In some embodiments, the populations of transformed bacteria are created from *Corynebacterium* X84253. In some embodiments, the populations of transformed bacteria are created from *Dermacoccus* AF409025. In some embodiments, the populations of transformed bacteria are created from *Finegoldia* AB109769. In some embodiments, the populations of transformed bacteria are created from *Haemophilus* AF224309. In some embodiments, the populations of transformed bacteria are created from *Methylobacterium* AY741717. *Neisseria* DQ409137.

Bacterial strains can be modified to avoid undesired reactions, inflammation, for methods to easily remove the bacteria, attenuate the bacteria, and for preventing the release of unwanted bacterial biomolecules that can be detrimental to the host.

In some bacteria there are toxic proteins that can be involved with lysis and inflammation. Bacteria for example can secrete toxins such as endotoxins and exotoxins. Endotoxins are cell associated substances that are structural components of the bacteria and are released from bacteria or from bacterial cells that are a result of lysis from the host defense mechanisms. Exotoxins are secreted by bacteria and can be small biomolecules, proteins, and can also be minimal peptides that act enzymatically. Several examples of bacterial toxins include but are not limited to hemolysin (*E. coli*), alpha toxin (*S. aureus*), leukocidin (*S. aureus*), CAMP factor (*Propionibacterium*), hyaluronidase (*Propionibacterium*), neuraminidase (*Propionibacterium*), enterotoxin B (*S. aureus*), verotoxin (*E. coli*). For example *Propionibacterium acnes* naturally make the biomolecule CAMP Factor, which has a co-hemolytic activity with sphingomyelinase that can confer cytotoxicity to keratinocytes and macrophages. The CAMP Factor together with the acid sphingomyelinase from host cells can lead to lysis and inflammation in the host. In another example, hemolysis is a mechanism that is employed by many bacterial pathogens that work to degrade, invade host cells and to resist the hosts' immune system. *P. acnes* carries within its genome 5 different CAMP homologs (CAMP1, CAMP2, CAMP3, CAMP4 and CAMP5). Many other types of bacteria can also secrete cytotoxins. *Staphylococcus aureus*, for example, can produce a wide variety of virulence factors that include but are not limited to enzymes, toxins, superantigens, exfoliative toxins, alpha toxin, beta toxin, delta toxin, and several types of bicomponent toxins.

In some bacteria, lipase can be used for a beneficial effect. In some microbes, genes for lipases are not knocked out as lipases can be used to break down oils in subjects suffering from axillary odor or plantar odor. In some embodiments, *Propionibacterium* is engineered to release lipases to reduce sebaceous secretions.

In order to prevent detrimental effects from virulence factors, modifications can be performed to knock out specific genes of interest that are involved in the secretion of toxic factors of the bacteria to create conditional mutants. Conditional mutants can be described as having a wild type phenotype under certain permissive environmental conditions and a mutant phenotype under other restrictive conditions. In some embodiments, genes encoding toxic proteins can be mutated or knocked out to prevent nosocomial infections or disease symptoms in a host. In some embodiments, genes encoding enzymes that cause inflammation in a host can be mutated or knocked out to prevent manifestation of disease in a host. In some embodiments, genes encoding proteins involved in the synthesis of host viral factors can be mutated or knocked out in the bacteria. In some embodiments, the genes are for CAMP factor. In some embodiments the genes are for lipases. However, in some microbes, genes for lipases are not knocked out as lipases can be used to break down oils in subjects suffering from axillary odor or plantar odor. In some embodiments, *Propionibacterium* is engineered to release lipases to reduce sebaceous secretions. In some embodiments, the genes are for alpha toxin. In some embodiments, the genes are for beta toxin. In some embodiments the genes are for delta toxin. In some embodiments, the genes are for types of bicomponent toxins. In some embodiments, the genes are for hemolysins.

Several microbes do not require any growth factors and can synthesize essential purines, pyrimidines, amino acids and vitamins, in which they can start with a carbon source as part of their own metabolism. However, some types of microbes will require purines, pyrimidines, amino acids and vitamins in order to grow, and must be added in culture media to grow these microbes. By genetically modifying microbes so that they require a growth factor not needed by a wild type, a person skilled in the art can produce genetically modified "auxotrophs" or a mutant organism that has a nutritional requirement not shared by the parent organism.

Genetically modified microbes can be modified so that they are nutritional auxotrophs. In order to create a dependency on their surroundings for survival, one can control the amount of microbes are in a microenvironment, or one can eliminate a population of microbes by depleting the environment of a necessary nutrient. In several embodiments, the microbe comprises a genome with a mutation or knock out in a gene that codes for glutamine synthetase. In several embodiments, the microbe comprises a genome with a mutation or knock out in a gene that codes for asparagine synthetase. In several embodiments, the microbe comprises a genome with a mutation or knock out in a gene that codes for aspartokinase. In several embodiments, the microbe comprises a genome with a mutation or knock out in a gene that codes for aspartate semialdehyde dehydrogenase.

Toxins are also secreted by many fungi, which allow their successful colonization and infection of hosts under predisposing conditions. Secreted proteins can be involved in the virulence of several fungi species. For example, hydrolytic enzyme production, which also plays a role in the pathogenicity of bacteria and yeasts are commonly associated with virulence. Several toxins by fungi include but are not limited to secreted asparyl proteinases (Sap) (*C. albicans*), phospholipase B enzymes (*C. albicans*), lipases (*C. albicans*). In order to prevent infection by fungi, specific genes can be mutated or knocked out to prevent virulent factors from causing disease in a host.

Fungal cells can be genetically engineered to secrete biomolecules. In several embodiments described herein, populations of transformed fungal cells are created from members from a group consisting of the genus. In several embodiments described herein, populations of transformed bacteria are created from bacterial members from a group consisting of the genus *Candida*. In several embodiments described herein, populations of transformed bacteria are created from bacterial members from a group consisting of *Candida albicans*, *Candida glabrata*, *Candida tropicalis*, *Candida parapsilosis*, and *Candida krusei*.

In certain embodiments a composition comprises one or more genetically modified microbes. In some embodiments a composition comprises at least 1, at least 2, at least 3, at least 4, at least 5, at least 6, at least 7, at least 8, at least 9, or at least 10 genetically modified microbes. In some embodiments, a composition comprises 2, 3, 4, 5, 6, 7, 8, 9 or 10 or more genetically modified microbes. In certain embodiments a genetically modified microbe in a composition is configured to express one or more genes of interest. In certain embodiments a composition comprises a microbe that is genetically modified so that the expression of a pathogenic molecule (e.g., a pathogenic protein endogenous to the microbe) is substantially reduced or eliminated. In some embodiments a composition comprises a genetically modified microbe where one or more genes (e.g., endogenous essential genes) of the microbe are knocked out. In some embodiments a composition comprises a genetically modified microbe configured to express one or more essential genes under the direction of an inducible promoter.

In certain embodiments a composition comprises a pharmaceutical acceptable excipient or carrier. Pharmaceutical acceptable excipient or carriers contemplated for use herein are often not toxic to a genetically modified microbe. Pharmaceutical compositions for use in accordance with the invention thus can be formulated in a suitable manner using one or more physiologically acceptable carriers comprising excipients and auxiliaries, which can be used pharmaceutically. Proper formulation can depend upon the route of administration chosen. In particular, a suitable formulation, ingredient, excipient, the like or combinations thereof as listed in "Remington's Pharmaceutical Sciences," Mack Publishing Co., Easton, Pa., 18th edition, 1990, can be used with a composition described herein. Compositions herein can be incorporated into or used with a suitable material described in Remington's.

As used herein the term "pharmaceutically acceptable" and "physiologically acceptable" mean a biologically acceptable formulation, gaseous, liquid or solid, or mixture thereof, which is suitable for one or more routes of administration, in vivo delivery or contact. Such formulations include solvents (aqueous or non-aqueous), solutions (aqueous or non-aqueous), emulsions (e.g., oil-in-water or water-in-oil), suspensions, syrups, elixirs, dispersion and suspension media, coatings, isotonic and absorption promoting or delaying agents, compatible with pharmaceutical administration or in vivo contact or delivery. Aqueous and non-aqueous solvents, solutions and suspensions may include suspending agents and thickening agents. Such pharmaceutically acceptable carriers include tablets (coated or uncoated), capsules (hard or soft), microbeads, powder, granules and crystals. Supplementary active compounds (e.g., preservatives, antibacterial, antiviral and antifungal agents) can also be incorporated into the compositions.

Genetically engineered microbes can be placed within excipients that are optimal for the survival of the bacteria or the fungus. In several embodiments described herein, compositions are described which comprise vehicles or excipients that help maintain the integrity and viability of the bacteria. Vehicles as described herein can refer to a substance of no therapeutic value that is used to convey an active medicine for administration. Pharmaceutical vehicle as described herein can refer to a carrier or inert medium used as a solvent in which the medicinally active agent is formulated and or administered. Vehicles can include polymeric micelles, liposomes, lipoprotein-based carriers, nano-particle carriers, dendrimers, and other vehicles for bacteria that are known to one skilled in the art. An ideal vehicle can be non-toxic, biocompatible, non-immunogenic, biodegradable, and can avoid recognition by the host's defense mechanisms. In several embodiments described herein, compositions are described which comprise vehicles or excipients that help maintain the integrity of the fungus. In some embodiments, the vehicles are pharmaceutical vehicles. In some embodiments, the pharmaceutical vehicles include pharmaceutical compositions. In some embodiments, the vehicle is polymeric micelles. In some embodiments, the vehicle is liposomes. In some embodiments, the vehicle is lipoprotein-based carriers. In some embodiments, the vehicle is nano-particle carriers. In some embodiments, the vehicle is dendrimers.

Pharmaceutical compositions can be formulated to be compatible with a particular route of administration. Thus, pharmaceutical compositions include carriers, diluents, or excipients suitable for administration by various routes.

In some embodiments, a composition is formulated, for example, as a topical (e.g., dermal) formulation. In some embodiments, a composition is formulated, for example, for topical administration to a mammal. A topical formulation may include, for example, a formulation such as a gel formulation, a cream formulation, a lotion formulation, a paste formulation, an ointment formulation, an oil formulation, and a foam formulation. The composition further may include, for example, an absorption emollient.

Additional examples of a composition can optionally be formulated to be delivered to the *mucosum*, or by inhalation, respiration, intranasal, oral, buccal, or sublingual.

Salts may be added. Non-limiting examples of salts include acetate, benzoate, besylate, bitatrate, bromide, carbonate, chloride, citrate, edetate, edisylate, estolate, fumarate, gluceptate, gluconate, hydrobromide, hydrochloride, iodide, lactate, lactobionate, malate, maleate, mandelate, mesylate, methyl bromide, methyl sulphate, mucate, napsylate, nitrate, pamoate (embonate, phosphate, diphosphate, salicylate and disalicylate, stearate, succinate, sulphate, tartrate, tosylate, triethiodide, valerate, aluminium, benzathine, calcium, ethylene diamine, lysine, magnesium, meglumine, potassium, procaine, sodium, tromethamine or zinc.

Chelating agents may be added. Non-limiting examples of chelating agents include ethylenediamine, ethylene glycol tetraacetic acid, 1,2-bis(o-aminophenoxy)ethane-N,N,N',N'-tetraacetic acid, Penicillamine, Deferasirox, Deferiprone, Deferoxamine, 2,3-Disulfanylpropan-1-ol, Dexrazoxane, Iron(II,III) hexacyanoferrate(II,III), (R)-5-(1,2-dithiolan-3-yl)pentanoic acid, 2,3-Dimercapto-1-propanesulfonic acid, Dimercaptosuccinic acid, or diethylene triamine pentaacetic acid.

Buffering agents may be added. Non-limiting examples of buffering agents include phosphate, citrate, acetate, borate, TAPS, bicine, tris, tricine, TAPSO, HEPES, TES, MOPS, PIPES, cacodylate, SSC, MES or succinic acid.

Cosolvents may be added. Non-limiting examples of cosolvents contain hydroxyl groups or other polar groups, for example, alcohols, such as isopropyl alcohol; glycols, such as propylene glycol, polyethyleneglycol, polypropylene glycol, glycol ether; glycerol; polyoxyethylene alcohols and polyoxyethylene fatty acid esters. Non-limiting examples of cosolvents contain hydroxyl groups or other polar groups, for example, alcohols, such as isopropyl alcohol; glycols, such as propylene glycol, polyethylenegly-col, polypropylene glycol, glycol ether; glycerol; polyoxyethylene alcohols and polyoxyethylene fatty acid esters.

Supplementary compounds (e.g., preservatives, antioxidants, antimicrobial agents including biocides and biostats such as antibacterial, antiviral and antifungal agents) can also be added. Pharmaceutical compositions may therefore include preservatives, anti-oxidants and antimicrobial agents.

Preservatives can be used to inhibit undesired microbial growth or increase stability of ingredients thereby prolonging the shelf life. Suitable preservatives are known in the art and include, for example, EDTA, EGTA, benzalkonium chloride or benzoic acid or benzoates, such as sodium benzoate. Antioxidants include, for example, ascorbic acid, vitamin A, vitamin C, vitamin E, tocopherols, and similar vitamins or provitamins, green tea, lycopene, Resveratrol, etc.

Topical (skin, e.g., face) formulations can include, for example, a liquid or cream with or without moisturizer. Components of a liquid or cream with moisturizer (moisturizing formulation) can be: Colloidal oatmeal, niacinamide, ceramides, phospholipids, triglycerides, fats or fatty acids, free fatty alcohols, waxes (esters, diesters, triesters, etc.), hydroxyacid diesters, squalene, sterol esters, cholesterol, lactones, etc.

In several embodiments herein, methods are described to preserve the genetically engineered bacteria cryogenically for future use. In several embodiments herein, methods are described to preserve the bacteria by freeze drying the genetically engineered bacteria for future use. In several embodiments herein, methods are described to preserve the genetically engineered fungus cryogenically for future use. In several embodiments herein, methods are described to preserve the genetically engineered fungus by freeze drying the bacteria for future use.

Particular non-limiting classes of anti-virals include reverse transcriptase inhibitors; protease inhibitors; thymidine kinase inhibitors; sugar or glycoprotein synthesis inhibitors; structural protein synthesis inhibitors; nucleoside analogues; and viral maturation inhibitors. Specific non-limiting examples of anti-virals include nevirapine, delavirdine, efavirenz, saquinavir, ritonavir, indinavir, nelfinavir, amprenavir, zidovudine (AZT), stavudine (d4T), larnivudine (3TC), didanosine (DDI), zalcitabine (ddC), abacavir, acyclovir, penciclovir, ribavirin, valacyclovir, ganciclovir, 1,-D-ribofuranosyl-1,2,4-triazole-3 carboxamide, 9→2-hydroxyethoxy methylguanine, adamantanamine, 5-iodo-2'-deoxyuridine, trifluorothymidine, interferon and adenine arabinoside.

Pharmaceutical formulations and delivery systems appropriate for the compositions and methods of the invention are known in the art (see, e.g., Remington: The Science and Practice of Pharmacy (2003) $20^{th}$ ed., Mack Publishing Co., Easton, Pa.; Remington's Pharmaceutical Sciences (1990) $18^{th}$ ed., Mack Publishing Co., Easton, Pa.; The Merck Index (1996) $12^{th}$ ed., Merck Publishing Group, Whitehouse, N.J.; Pharmaceutical Principles of Solid Dosage Forms (1993), Technonic Publishing Co., Inc., Lancaster, Pa.; Ansel ad Soklosa, Pharmaceutical Calculations (2001) $11^{th}$ ed., Lippincott Williams & Wilkins, Baltimore, Md.; and Poznansky et al., Drug Delivery Systems (1980), R. L. Juliano, ed., Oxford, N.Y., pp. 253-315).

In certain embodiments a composition comprises a molecule configured to engage, either directly or indirectly, an inducible promoter. In some embodiments a molecule configured to engage an inducible promoter in configured to activate the inducible promoter (e.g., activate gene transcription/translation). In some embodiments a molecule configured to engage an inducible promoter is configured to repress activation of gene expression by the inducible promoter. In some embodiments a molecule configured to engage an inducible promoter comprises a compound, alcohol, nutrient, metal, amino acid (e.g., an amino acid such as a synthetic amino acid), sugar or sugar analog (e.g., lactose, arabinose, IPTG), peptide, or protein. In certain embodiments a composition comprises lactose, arabinose, IPTG, tryptophan, or tetracycline.

In certain embodiments herein, methods of making a nucleic acid for transformation or integration into a microbe genome are described. Methods can include providing a nucleic acid sequence encoding a peptide, and joining said nucleic acid sequence to a nucleic acid sequence encoding a regulatory element or a nucleic acid encoding a secretory peptide. In some embodiments, a nucleic acid comprises a sequence encoding a peptide wherein the peptide comprises an amino acid sequence of a secretory peptide. In some embodiments, a nucleic acid comprises signal sequence for secretion. In some embodiments, a nucleic acid comprises a sequence, or encodes a polypeptide sequence that is recognized by a cell secretory pathway. In some embodiments, a nucleic acid encodes a non-secreted protein (e.g., an enzyme) for production of a biomolecule of interest. In some embodiments, a signal sequence for secretion comprises the sequence SEQ ID NO: 212, SEQ ID NO: 213, SEQ ID NO: 214, SEQ ID NO: 215, or SEQ ID NO: 216.

Those skilled in the art will appreciate that gene expression levels are dependent on many factors, such as promoter sequences and regulatory elements. Another factor for maximal protein selection is adaptation of codons of the transcript gene to the typical codon usage of a host. As noted for most bacteria, a small subset of codons are recognized by tRNA species leading to translational selection and is important in the limitations of protein expression. In this aspect, many synthetic genes can be designed to increase their protein expression level. The design process of codon optimization can be to alter rare codons to codons known for protein expression efficiency. In some embodiments, codon selection is described, wherein codon selection can be performed by using algorithms that are known to those skilled in the art to create synthetic genetic transcripts optimized for high protein yield. Programs containing algorithms for codon optimization are known to those skilled in the art. Programs can include, for example, OptimumGene™, GeneGPS® algorithms, etc. Additionally synthetic codon optimized sequences can be obtained commercially for example from Integrated DNA Technologies and other commercially available DNA sequencing services. In some embodiments, peptides for secretion are described wherein the genes for the peptides for secretion are codon optimized for expression in humans. In some embodiments, peptides for secretion are described, wherein the genes for the complete gene transcript are codon optimized for expression bacteria, which can include gene transcripts a secretory peptide and other peptides that are known to increase the level of expression. In some embodiments, peptides are described, wherein genes for the peptide for secretion are optimized to have selected codons specifically for protein expression in bacterial and fungal cells.

The term "subject" includes but is not limited to a subject having or at risk of having a disorder which would benefit from contact with or administration of a genetically modified microbe as set forth herein. Subjects include mammalian animals (mammals), such as humans, a non-human primate (apes, gibbons, gorillas, chimpanzees, orangutans, macaques), a domestic or companion animal (dogs and cats), a farm animal (poultry such as chickens and ducks, horses, cows, goats, sheep, pigs), and experimental animals (mouse, rat, rabbit, guinea pig). Subjects include veterinary animals, as well as animal disease models, for example, mouse and other animal models of a skin disorder.

Invention genetically modified microbes and compositions comprising genetically modified microbes can be employed in various methods and uses and medicaments. Such methods and uses and medicaments include, for example, administration ex vivo and in vivo. In various embodiments, methods and uses and medicaments provided include methods and uses and medicaments for treatment of skin disorders.

Skin disorders can arise from genetic predisposition to skin disorders, as well as the disturbance of the natural flora or natural bacteria that can reside on the skin. Several types of skin disorders exist for example but are not limited to acne, actinic keratosis, alopecia areata, athlete's foot, onychomycosis, atopic dermatitis, osmidrosis, eczema, fungal infection of the nails, psoriasis, rosacea, slow wound healing, folliculitis, keratosis pilaris, perioral dermatitis, angiofibromas, cutaneous inflammation, cosmesis, aging damage, dyschromia, premature greying hair, and seborrhea. In several embodiments described herein, methods to treat skin disorders are described. In several embodiments, methods to treat rosacea are described. In several embodiments, methods to treat alopecia are described. In several embodiments, methods to treat onychomycosis are described. In several embodiments, methods to treat osmidrosis are described. In several embodiments, methods to treat slow wound healing are described. In several embodiments, methods to treat premature greying hair are described. In several embodiments, methods to treat cutaneous inflammation are described. In several embodiments, methods to treat dyschromia are described.

Acne or acne vulgaris, is a common skin disease that can affect the face, neck, chest, and back. It is characterized by the regions on the skin that has seborrhea. Regions of the skin that have acne, can also have comedones, papules, nodules, cysts, boils, cystic acne and pimples. Acne can be caused by hormones, such as testosterone and can be affected by associated sebaceous glands. Causes for acne can be from hormonal, genetic and infectious effects. Management for acne can be the use of topical medications such as benzoyl peroxide, salicylic acid, and hormones. More common can be the use of antibiotics to treat acne, however, with the ability to develop bacterial resistance, many types of antibiotics are becoming less effective.

*Propionibacterium acnes* (*P. acnes*) is an anaerobic bacterial species that is widely concluded to cause acne. *Staphylococcus aureus* a natural floral bacterium of the skin is also believed to be an opportunistic bacteria to infect the skin even though it is seen in both healthy and infected skin. However it has been shown in studies that *P. acnes* as well as *S. aureus* have been developing antibiotic resistance, thereby increasing the need to develop a new treatment for skin disorders that are normally treated with antibiotics. In several embodiments described herein, genetically modified bacteria that secrete biomolecule(s) are used to treat acne. In several embodiments, described herein, genetically modified fungus that secretes biomolecules are used to treat acne.

Rosacea as described herein, refer to a chronic condition characterized by facial erythema and sometimes pimples. Rosacea has four subtypes, three affecting the skin and the fourth affecting the eyes (ocular type). Earlier treatment was the use of topical steroids, however, treatment in the form of topical steroids can aggravate the condition with longtime usage. Therefore new methods of treatment have been currently researched. Rosacea affects both sexes, but is almost three times more common in women.

Rosacea begins as redness on the central face across the cheeks, nose, or forehead, but can also less commonly affect the neck, chest, ears, and scalp. In some cases, additional symptoms, such as semi-permanent redness, telangiectasia (dilation of superficial blood vessels on the face), red domed papules (small bumps) and pustules, red gritty eyes, burning and stinging sensations, and in some advanced cases, a red lobulated nose, rhinophyma, may develop. Triggers that cause episodes of flushing and blushing play a part in the development of rosacea. Exposure to temperature extremes can cause the face to become flushed as well as strenuous exercise, heat from sunlight, severe sunburn, stress, anxiety, cold wind, and moving to a warm or hot environment from a cold one such as heated shops and offices during the winter. There are also some food and drinks that can trigger flushing, including alcohol, food and beverages containing caffeine (especially, hot tea and coffee), foods high in histamines and spicy food.

Certain medications and topical irritants can quickly trigger rosacea. Some acne and wrinkle treatments that have been reported to cause rosacea include microdermabrasion and chemical peels, as well as high dosages of isotretinoin, benzoyl peroxide, and tretinoin. Steroid induced rosacea is the term given to rosacea caused by the use of topical or nasal steroids. These steroids are often prescribed for seborrheic dermatitis. Dosage should be slowly decreased and not immediately stopped to avoid a flare up. Intestinal flora can play a role in causing the disease.

Oral tetracycline antibiotics (tetracycline, doxycycline, minocycline) and topical antibiotics such as metronidazole are usually the first line of defense prescribed by doctors to relieve papules, pustules, inflammation and some redness.

Oral antibiotics can help to relieve symptoms of ocular rosacea. If papules and pustules persist, then sometimes isotretinoin can be prescribed. Isotretinoin has many side effects and is normally used to treat severe acne but in low dosages is proven to be effective against papulopustular and phymatous rosacea. Some individuals respond well to the topical application of sandalwood oil on the affected area, particularly in reducing the prevalence of pustules and erythema. The oral antibiotics can be a first line of defense against bacteria on the skin that can trigger the rosacea, however due to the rise of antibiotic resistance, new developments have been sought in order to treat both bacterial ailments of the skin as well as rosacea. In several embodiments, described herein, genetically modified microbes are used for treatment of rosacea.

Alopecia areata as described herein refer to a condition in which hair is lost from some or all areas of the body, usually from the scalp. Because it causes bald spots on the scalp, especially in the first stages, it is sometimes called spot baldness. In 1-2% of cases, the condition can spread to the entire scalp (alopecia totalis) or to the entire epidermis (alopecia universalis). Conditions resembling AA, and having a similar cause, occur also in other species.

The condition is thought to be a systemic autoimmune disorder in which the body attacks its own antigen hair follicles and suppresses or stops hair growth. T cell lymphocytes cluster around affected follicles, causing inflammation and subsequent hair loss. A few cases of babies being born with congenital AA have been reported, but these are not cases of autoimmune disease, because an infant is born without a definitely developed immune system. Endogenous retinoids metabolic defect is a key part of the pathogenesis of the AA. Also, some evidence indicates AA affects the part of the hair follicle associated with hair color. Hair that has turned gray cannot be affected. In some embodiments, genetically modified microbes are used for treatment of an immune disorder.

Onychomycosis refers to a fungal infection of the nail. The infection can be caused by pathogens of onychomycosis include dermatophytes, *Candida*, and non dermatophytic molds. Dermatophytes are the fungi most commonly responsible for onychomycosis in the temperate western countries; while *Candida* and non dermatophytic molds are more frequently involved in the tropics and subtropics with a hot and humid climate. Pathogens can include *Candida* and non dermatophytic molds, in particular members of the mold generation *Scytalidium* (Neoscytalidium), Scopulariopsis, and *Aspergillus*. *Candida* spp. mainly cause fingernail onychomycosis in people whose hands are often submerged in water. *Scytalidium* mainly affects people in the tropics, though it persists if they later move to areas of temperate climate. Treatments mostly include topical or antifungal medications such as terbinafine, itraconazole, and fluconazole.

Osmidrosis refers to body order, in which sebaceous and apocrine glands can pay a role. Medical conditions can be referred to as bromhidrosis, apocrine bromhidrosis, osmidrosis, ozochrotia, fetid sweat, and malodorous sweating. Osmidrosis or bromhidrosis is defined by a foul odor due to a water rich environment that is supportive of bacterial growth which is also caused by an abnormal increase in perspiration. In some embodiments, methods are used for the treatment of osmidrosis.

"Poor wound healing" can be caused by a poor immune system, diabetes mellitus, low human growth hormone, rheumatoid arthritis, poor circulation from vascular or arterial diseases, zinc deficiency, vitamin deficiency, lupus, etc. In several cases, poorwound healing can lead to opportunistic infections by the normal flora. In several embodiments, treatment for wound healing using genetically modified microbes are described.

"Cutaneous inflammation" and "Chronic cutaneous inflammation" can be hallmarked by macrophage infiltration of the dermal area. During an infection, the macrophage response is to mediate a chronic inflammation, which is seen in several inflammatory dermatoses which includes but is not limited to psoriasis, atopic dermatitis, and chronic contact dermatitis. In order to decrease the inflammatory response, treatments have been described in which elimination of the macrophage at the site of the inflammation is sought. One way is to block the activity of the effector molecules or the cytokines that are produced by the macrophage. Another way is to target the macrophage for apoptotic elimination locally during the inflammation by engineering an immunotoxin. Treatment can be for other skin disorders caused by cutaneous inflammation or chronic cutaneous inflammation such as cutaneous graft-versus-host disease, lichenoid, sclerodermatous, granuloma annulare, sarcoid, chronic contact dermatitis, psoriasis, UV skin injuries, atopic dermatitis, and cutaneous T-Cell lymphoma. However, most ways to eliminate the local response is time consuming. In this respect, having an engineered microbe population to eliminate the macrophage locally at the site of chronic cutaneous inflammation can provide a fast treatment for either cutaneous inflammation, or chronic cutaneous inflammation.

The invention provides kits including genetically modified microbes, such as a bacterium of the genus *Propionibacterium*, compositions and pharmaceutical formulations thereof, packaged into suitable packaging material. Kits can be used in various in vitro, ex vivo and in vivo methods and uses, for example a treatment method or use as disclosed herein.

A kit typically includes a label or packaging insert including a description of the components or instructions for use in vitro, in vivo, or ex vivo, of the components therein. A kit can contain a collection of such components, e.g., a genetically modified microbe, such as a bacterium of the genus *Propionibacterium* alone, or in combination with another therapeutically useful composition (e.g., an anti-inflammatory drug).

The term "packaging material" refers to a physical structure housing the components of the kit. The packaging material can maintain the components sterilely, and can be made of material commonly used for such purposes (e.g., paper, corrugated fiber, glass, plastic, foil, ampules, vials, tubes, etc.).

Kits can comprise containers for single or multiple use. For example, a representative single use kit is a foil sachet that optionally has two sides sealed off from one another. One side would contain the microbe "composition" and the other side the liquid or cream moisturizing formulation. Once opened, the contents would be mixed and applied to the skin (e.g., face). A representative multiple use kit would be pump, bottle or spray. The pump, bottle or spray can be configured for separation of the microbe "composition" which when deployed can be mixed with and applied to the skin (e.g., face).

Kits of the invention can include labels or inserts. Labels or inserts include "printed matter," e.g., paper or cardboard, or separate or affixed to a component, a kit or packing material (e.g., a box), or attached to an ampule, tube or vial containing a kit component. Labels or inserts can additionally include a computer readable medium, such as a disk (e.g., hard disk), optical disk such as CD- or DVD-ROM/RAM, DVD, MP3, magnetic tape, or an electrical storage media such as RAM and ROM or hybrids of these such as magnetic/optical storage media, FLASH media or memory type cards.

Labels or inserts can include identifying information of one or more components therein, dose amounts, clinical pharmacology of the active ingredient(s) including mechanism of action, pharmacokinetics and pharmacodynamics. Labels or inserts can include information identifying manufacturer information, lot numbers, manufacturer location and date.

Labels or inserts can include information on a condition, disorder, disease or symptom for which a kit component may be used. Labels or inserts can include instructions for the clinician or for a subject for using one or more of the kit components in a method, use, treatment protocol or therapeutic regimen. Instructions can include dosage amounts, frequency or duration, and instructions for practicing any of the methods and uses, treatment protocols or therapeutic regimes set forth herein.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described herein.

All applications, publications, patents and other references, GenBank citations and ATCC citations cited herein are incorporated by reference in their entirety. In case of conflict, the specification, including definitions, will control.

With respect to the use of substantially any plural and/or singular terms herein, those having skill in the art can translate from the plural to the singular and/or from the singular to plural as is appropriate to the context and/or application. Thus, the singular forms "a," "and," and "the" include plural referents unless the context clearly indicates otherwise. The various singular/plural permutations can be expressly set forth herein for sake of clarity. Accordingly, reference to a "protein," or an "gene," for example, includes a plurality of proteins or genes.

It will be understood by those within the art that, in general, terms used herein, and especially in the appended claims (for example, bodies of the appended claims) are generally intended as "open" terms (for example, the term "including" should be interpreted as "including but not limited to," the term "having" should be interpreted as "having at least," the term "includes" should be interpreted as "includes but is not limited to," etc.). It will be further understood by those within the art that if a specific number of an introduced claim recitation is intended, such an intent will be explicitly recited in the claim, and in the absence of such recitation no such intent is present. For example, as an aid to understanding, the following appended claims can contain usage of the introductory phrases "at least one" and "one or more" to introduce claim recitations. However, the use of such phrases should not be construed to imply that the introduction of a claim recitation by the indefinite articles "a" or "an" limits any particular claim containing such introduced claim recitation to embodiments containing only one such recitation, even when the same claim includes the introductory phrases "one or more" or "at least one" and indefinite articles such as "a" or "an" (for example, "a" and/or "an" should be interpreted to mean "at least one" or "one or more"); the same holds true for the use of definite articles used to introduce claim recitations. In addition, even if a specific number of an introduced claim recitation is explicitly recited, those skilled in the art will recognize that such recitation should be interpreted to mean at least the recited number (for example, the bare recitation of "two recitations," without other modifiers, means at least two recitations, or two or more recitations). Furthermore, in those instances where a convention analogous to "at least one of A, B, and C, etc." is used, in general such a construction is intended in the sense one having skill in the art would understand the convention (for example, "a system having at least one of A, B, and C" would include but not be limited to systems that have A alone, B alone, C alone, A and B together, A and C together, B and C together, and/or A, B, and C together, etc.). In those instances where a convention analogous to "at least one of A, B, or C, etc." is used, in general such a construction is intended in the sense one having skill in the art would understand the convention (for example, "a system having at least one of A, B, or C" would include but not be limited to systems that have A alone, B alone, C alone, A and B together, A and C together, B and C together, and/or A, B, and C together, etc.). It will be further understood by those within the art that virtually any disjunctive word and/or phrase presenting two or more alternative terms, whether in the description, claims, or drawings, should be understood to contemplate the possibilities of including one of the terms, either of the terms, or both terms. For example, the phrase "A or B" will be understood to include the possibilities of "A" or "B" or "A and B."

In addition, where features or aspects of the disclosure are described in terms of Markush groups, those skilled in the art will recognize that the disclosure is also thereby described in terms of any individual member or subgroup of members of the Markush group.

As used herein, numerical values are often presented in a range format throughout this document. The use of a range format is merely for convenience and brevity and should not be construed as an inflexible limitation on the scope of the invention. Accordingly, the use of a range expressly includes all possible subranges, all individual numerical values within that range, and all numerical values or numerical ranges include integers within such ranges and fractions of the values or the integers within ranges unless the context clearly indicates otherwise. This construction applies regardless of the breadth of the range and in all contexts throughout this patent document. Thus, all ranges disclosed herein also encompass any and all possible sub-ranges and combinations of sub-ranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like include the number recited and refer to ranges which can be subsequently broken down into sub-ranges as discussed above. Finally, as will be understood by one skilled in the art, a range includes each individual member. Thus, for example, a group having 1-3 articles refers to groups having 1, 2, or 3 articles. Similarly, a group having 1-5 articles refers to groups having 1, 2, 3, 4, or 5 articles, and so forth.

While various aspects and embodiments have been disclosed herein, other aspects and embodiments will be apparent to those skilled in the art. The various aspects and embodiments disclosed herein are for purposes of illustration and are not intended to be limiting, with the true scope and spirit being indicated by the following claims.

One skilled in the art will appreciate that, for this and other processes and methods disclosed herein, the functions performed in the processes and methods can be implemented in differing order. Furthermore, the outlined steps and operations are only provided as examples, and some of the steps and operations can be optional, combined into fewer steps and operations, or expanded into additional steps and operations without detracting from the essence of the disclosed embodiments.

One skilled in the art will appreciate that, for this and other processes and methods disclosed herein, the functions performed in the processes and methods can be implemented in differing order. Furthermore, the outlined steps and operations are only provided as examples, and some of the steps and operations can be optional, combined into fewer steps and operations, or expanded into additional steps and operations without detracting from the essence of the disclosed embodiments.

The examples set forth below illustrate certain embodiments and do not limit the technology.

EXAMPLES

Example 1. Isolation of the RT6 *P. acnes* Strain

E-swabs (Fisher) were used to collect bacteria from the human skin as follows: volunteer subjects were asked to wash their faces with soap and water and clean it with ethanol wipes before they applied the E-swab over their cheeks and forehead. The applicator was next transferred to a tube with the transfer medium. The tube was vortexed to release the bacteria into the medium. A 100-fold dilution of the transfer medium was plated onto RIC plates. After a week of anaerobic growth, colonies were observed on each plate. These colonies were grown in the BHI medium until they reached the appropriate density for DNA isolation. Genomic DNA was prepared using a commercial kit (Epicentre) and was PCR amplified using *P. acnes*-specific 16S rDNA primers Pas9/Pas11 (Table 1). The PCR fragments were gel purified and sequenced using the primer 16SFseq. The sequences were aligned to the 16S rDNA gene (NC_017550, SEQ ID NO:290) from ATTCC 11828 (type II) and ATCC 6919 (type I). The colonies that showed a C to T conversion at nucleotide 1315 were assigned as type II RT6. Colonies were also tested for the RecA gene to confirm they belonged to a type II strain. After PCR amplification with primers RecAF/RecAR, the fragments were gel purified and sequenced with primers RecAFseq and RecARseq. A combination of sequences obtained with both primers covered over 90% of the RecA gene. The sequenced RecA fragments were aligned to the RecA gene from ATCC 11828 and ATCC 6919 strains for a reference sequence.

TABLE 1

Primers used for isolation of the RT6 *P. acnes* strain

| Name | Sequence | Comment |
| --- | --- | --- |
| PAS9F | CCCTGCTTTTGTGGGGTG (SEQ ID NO: 217) | 16SrDNA upstream |
| PAS11R | CGACCCCAAAAGAGGGAC (SEQ ID NO: 218) | 16SrDNA downstream |
| 16SFseq | ATCGCGTCGGAAGTGTAATC (SEQ ID NO: 219) | Sequencing primer |
| RecAF | AGCTCGGTGGGGTTCTCTCATC (SEQ ID NO: 220) | RecA upstream |
| RecAR | GCTTCCTCATACCACTGGTCATC (SEQ ID NO: 221) | RecA downstream |
| RecAFseq | GGTACCACTGCCATCTTCATTA (SEQ ID NO: 222) | Sequencing upstream |
| RecARseq | CACCAGCAGGGAATCTGTATC (SEQ ID NO: 223) | Sequencing downstream |

Example 2. Molecular Cloning

PCR amplification was performed using Q5 high fidelity DNA polymerase (New England Biolab) and PCR machine (Eppendorf) following manufacturer's recommendations. For the gene assembly reactions, Gibson assembly method (NEBuilder HiFi DNA Assembly Cloning Kit, New England Biolab) and Golden Gate assembly method (NEB Golden Gate assembly Kit, New England Biolab) were used following manufacturer's recommendations.

Example 3. Isolation of Genomic DNA

Total genomic DNA was isolated from the bacterial strains by phenol-chloroform extraction according to the procedure described by Rhee (2011) with minor changes. *P. acnes* strains were cultured in brain heart infusion broth (BHI) at 37° C. until late log phase. After harvest the cells, the cell pellet was resuspended with 10 mM Tris-Cl pH 8.0, 10 mM Na$_2$EDTA and lysozyme (final concentration=1 mg/mL) was added. After incubation at 37° C. for 20 min., 10% of SDS was added (final concentration=1.4%) and incubated on ice for 10 min. The lysate was extracted 3 times with equal volume of phenol-chloroform mixture (25:24:1 of phenol, chloroform and isoamyl alcohol), and then the DNA was precipitated with ethanol and dried.

Example 4. Electroporation of *P. acnes*

*P. acnes* was transformed according to the procedure described by Cheong (2008) and Rhee et al. (2007). Cells were grown in 9 mL of BHI with Oxyrase for broth (Oxyrase) in a 13×100 screw cap tube until the OD 600 nm reached about 0.5. Cells were collected by centrifugation (4° C.; 4300 g; 10 min) and washed with ice-cold SG medium (glycerol, 10%; sucrose, 0.5 M) three times. Cells were resuspended in SG medium (about 5×109-1010 CFU/ml). These electro-competent cells were used immediately. Seventy-five microliters of cell suspension were mixed with DNA and transferred to chilled electroporation cuvette (1 mm gap). The electroporation conditions using a Bio-Rad electroporator were 1.5 KV, 25 µF and 600Ω. The time constant was set between 8.5 and 10 ms. After electroporation, cells were transferred to 2 ml of pre-warmed (37° C.) BHI with Oxyrase for broth. These cells were incubated at 37° C. for 10 hrs. Cells were collected by centrifugation (2000×g, 10 min.) at room temperature and spread on reinforced clostridial agar plate with antibiotics. Plates were incubated at 37° C. at anaerobic condition.

Example 5. Construction of the Growth Arrest Strain of *Bacillus subtilis*

The truncated dnaA gene of *B. subtilis* was amplified by PCR with the genome DNA of *B. subtilis* strain 168 as a template and the primers (d-B_F:aggaaggaTCCATG-GAAAATATATTAGACCTG (SEQ ID NO: 224), d-B_R: ctatgaccatgattacgCGCATGAATAACGGTCGTATG (SEQ ID NO: 225)). The DNA region with chloramphenicol gene and IPTG inducible promoter was amplified by PCR with primers (125_F:gcctgcaggtcgactTTAAGTTAT-TGGTATGACTGGTTTTAAG (SEQ ID NO: 226), 125_R: tccatggaTCCTTCCTCCTTTAATTGG (SEQ ID NO: 227)). These PCR products were assembled by NEBuilder@ HiFi DNA Assembly Cloning Kit. The product was digested by HindIII and the 3,257 bp fragment was self-ligated. The self-ligated DNA was transformed into *B. subtilis* strain and selected the transformants on LB with Cm (5 µg/mL) and the different concentration of IPTG (0, 0.05, 0.1 and 0.25 mM).

Example 6. Construction of the Growth Arrest Strains of *P. acnes*

Arabinose inducible fts operon. The arabinose inducible promoter and regulator of *B. subtilis* was truncated was amplified by PCR with the genome DNA of *B. subtilis* strain 168 as a template and the primers (araRE F:TGCAGTTCTAGACGACACAGGCTGACGAAATTA (SEQ ID NO: 228), araRE R:CGTAGCGAATTCCAT-TTCCCTGCCCTCCCGAA (SEQ ID NO: 229)). The 1468 bp of PCR product was ligated into pUC18 hydrolyzed by XbaI and EcoRI. The truncated fts operon of *P. acnes* was amplified by PCR with the genome DNA of *P. acnes* strain ATCC 11828 as a template and the primers (ftzope F CTGACTGAATTCGCTTCCCAACGGGGCCGTTT (SEQ ID NO: 230), ftzope R GACTGCGAATTCCT-GAAGAGCCGTCACCGACA (SEQ ID NO: 231)). The 1332 bp of PCR product hydrolyzed by EcoRI, was ligated into pUC18 with arabinose promoter also hydrolyzed by EcoRI. After insertion of the 1236 bp of DNA with erythromycin gene, this plasmid was introduced into *P. acnes* strain and transformants were selected on modified reinforced clostridial medium with L-arabinose (1.5% w/v).

Example 7. Lactose Inducible dnaA Gene

The β-galactose promoter region and truncated dnaA gene of *P. acnes* were amplified by PCR with the genome DNA of *P. acnes* strain ATCC11828 as a template and the primers (0410-1 F:GGCTTCTGGTCTCGAGTGTTGTG-GAACGACAACA (SEQ ID NO: 232), 0410-1 R:GGCTTCTGGTCTCGATGGCACCAACCTTAGAGAG (SEQ ID NO: 233), 0410-2 F GGCTTCTGGTCTCGC-CATGTCCGACACACCGTTC (SEQ ID NO: 234), 0410-2 R GGCTTCTGGTCTCGGGTAGAGACTGGGTAGA-GACG (SEQ ID NO: 235)). These PCR products and DNA fragment with antibiotic genes, erythromycin and chloramphenicol genes were ligated into pUC18 by Golden Gate assembly method (NEB Golden Gate assembly Kit, New England Biolab). This plasmid was introduced into *P. acnes* strain and transformants were selected on modified reinforced clostridial medium with lactose (1.0% w/v).

TABLE 2

List of primers

| Target gene | Name | Sequences (5'-3') |
|---|---|---|
| IL10 | I10 Ec F | CGTCACCATATGCACTCCTCCGCTCTGCT (SEQ ID NO: 236) |
| | I10 Ec R | GTAGCTGGATCCTCAGTTGCGGATCTTCATGG (SEQ ID NO: 237) |
| EGF | EgcEc F | CGATGCCATATGAACTCCGACTCCGAGTGT (SEQ ID NO: 238) |
| | EgfEc R | GTTCACGGATCCTCAGCGCAGCTCCCACCACT (SEQ ID NO: 239) |
| GH | GHEc F | CGTGACCATATGTTCCCGACCATCCCGCT (SEQ ID NO: 240) |
| | GHEc R | GTGACTGGATCCTCAGAAACCGCAGGAGCCCT (SEQ ID NO: 241) |

Example 8. Construction of CAMPII Mutant *P. acnes* Strain

From the start codon of CAMPII gene of *P. acnes*, 400 bp of truncated ORF was amplified by PCR with genome DNA of *P. acnes* ATCC 11828 strain as templates and the primers (0422NB-1 F:AGTAAACTTGGTCTGACATGAAGAA-GACCCATCTTG (SEQ ID NO: 242), 0422NB-1 R:TATATATATTTATTATCCGATGGACCTTGTTTTG-GAGAG (SEQ ID NO: 243)). The 438 bp of PCR product and DNA fragment with erythromycin and chloramphenicol resistance genes were ligated with pUC18 by NEBuilder HiFi DNA Assembly Cloning Kit and transformants of this ligation product were selected on LB with amp (100 µg/mL) and cm (20 mg/mL) plate. After transformation into *E. coli* dcm- dam-strain, the plasmid was introduced into *P. acnes* and selected anaerobically on reinforced clostridial medium with erm (5 µg/mL) or cm (5 µg/mL) plates. The CAMPII mutant colonies were checked by PCR.

Figure 9:
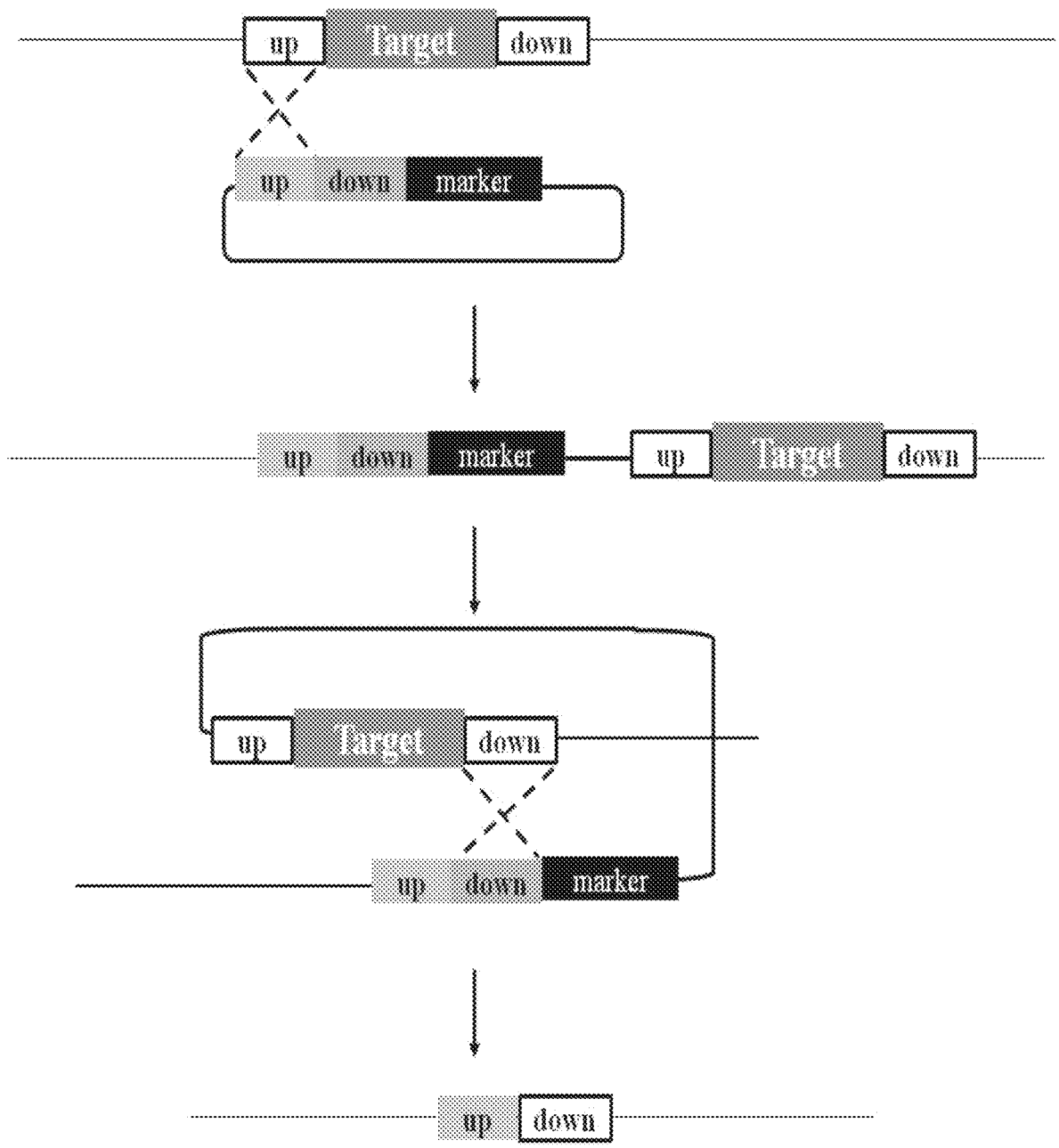
FIG. 9 shows a scheme for construction of a markerless mutant construction.

Example 9. Construction of Markerless Mutant *P. acnes* Strain (FIG. 9)

The upstream and downstream regions of target gene were amplified by PCR. These regions should be bigger than 500 bp. These DNA fragments were ligated with the plasmid that had antibiotic marker and didn't have replication origin for *P. acnes*. This suicide vector was introduced into *P. acnes* and the transformants were selected by antibiotics. After confirmation of these, cells were cultured in reinforced clostridial medium without antibiotics to allow the second homologous recombination. After streaking on the plate, the markerless mutant colonies were screened by PCR.

Example 10. Construction of Lactose Inducible IL10 Secretion *P. acnes* Strain The 1037 bp of β-galactose promoter region of *P. acnes* was amplified by PCR with the genome DNA of *P. acnes* strain ATCC11828 as a template and the primers (0505-1 F:TAAACTTGGTCTGACAGTGCGCACCGAT-GAGCGGCAGA (SEQ ID NO: 244), 0505-1_R: TTGCAAACATGGCACCAACCTTAGAGAGTCATG (SEQ ID NO: 245)). For secretion of IL10, the 188 bp of the signal peptide region was by PCR with the genome DNA of *B. subtilis* strain 168 as a template and the primers (0505-2_F GGTTGGTGCCATGTTTGCAAAACGATT-CAAAAC (SEQ ID NO: 246), 0505-2_R AGGAGTG-CATATGATAAATAGACATGGTTCCG (SEQ ID NO: 247)). The 568 bp of human IL10 ORF was amplified by PCR (0505-3_F:CTATTTAT-CATATGCACTCCTCCGCTCTG (SEQ ID NO: 248), 0505-3_R:TTATCCGATTCATGAGACTGTCAGTTGCG-GATCTTCATGG (SEQ ID NO: 249)). These PCR products and DNA fragment with erythromycin and chloramphenicol resistance genes were ligated with pUC18 by NEBuilder HiFi DNA Assembly Cloning Kit and transformants of this ligation product were selected on LB with amp (100 µg/mL) and cm (20 mg/mL) plate. After transformation into *E. coli* dcm- dam-strain, the plasmid was introduced into *P. acnes* and selected anaerobically on reinforced clostridial medium with erm (5 µg/mL) or cm (5 µg/mL) plates. After checking the transformant by PCR, induction by lactose and secretion of IL10 was analyzed by ELISA.

Example 11. MC/9 Cell Culture

The murine MC/9 cells were obtained from ATCC (CRL-8306) and were propagated in DMEM supplemented with 10% FBS (Gibco), 10% Rat T-STIM (BD), 2 mM glutamate, 0.05 mM 2-mercaptoethanol and pen/strep. Cells were maintained at a density of $2 \times 10^5$ cells/ml in a 5% $CO_2$ incubator at 37° C.

Example 12. Functional Assays for IL-10

The purified recombinant human IL-10 was quantified using a commercial ELISA for human IL-10 (Biolegend). The biological activity of the expressed IL-10 was tested by using a dose-dependent co-stimulation (with human IL-4) of MC/9 cell proliferation. Briefly, cells were spun down and washed twice with RPMI1640 (Gibco) to remove all traces of the Rat-T-STIM in the growth medium. Next, cells were re-suspended in DMEM supplemented with 10% FBS, 2 mM glutamate, pen/strep, 2-meracaptoethanal and 200 pg/ml human IL-4 (Peprotech) and were plated at a density of 20,000 cells per well in a 96-well plate. A commercial recombinant human IL-10 (Peprotech) was used to generate a standard curve. Cells were grown for 82 hours and cell proliferation was determined using an XTT assay (Biotium).

Example 13. Isolation of the R6 Type II *P. acnes*

Figure 10:
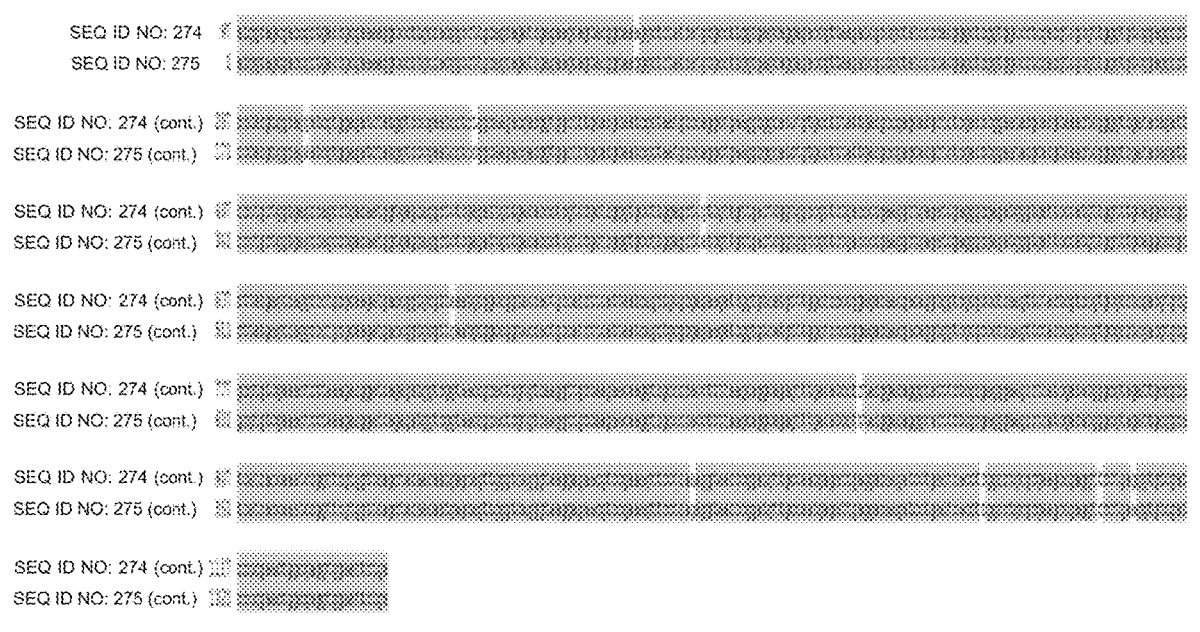

Isolated *P. acnes* strains were checked to determine what ribotypes they were, with the goal of isolating a Type II, RT6 *P. acnes*. From an alignment of the RecA gene from a type II and type I strains (FIG. 10), we can see 10 nucleotide differences. These variations are used to identify sub-types of *P. acnes*. The ATCC strain 11828 was used as a positive control for a type II *P. acnes*.

Figure 11:
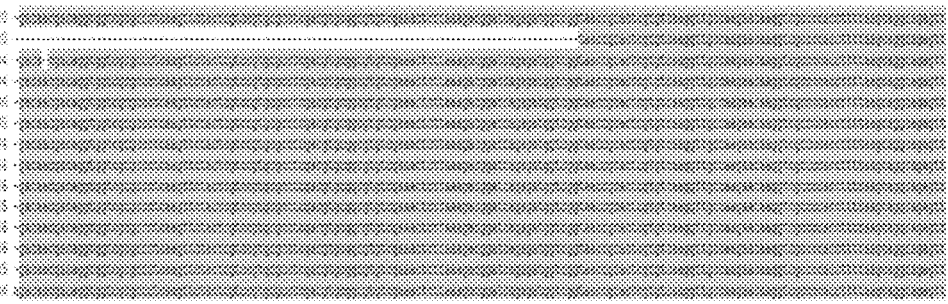
FIG. 11 shows an alignment of RecA genes sequenced from putative RT6 clones (RecA NCTC737, SEQ ID NO: 277; NC_017_41_RecA, SEQ ID NO: 278; NC_001_4_RecA, SEQ ID NO: 279; NC_003_18_RecA, SEQ ID NO: 280; NC_005_31_RecA, SEQ ID NO: 281; NC_007_33_RecA, SEQ ID NO: 282; NC_009_34_RecA, SEQ ID NO: 283; NC_011_35_RecA, SEQ ID NO: 284; NC_015_39_RecA, SEQ ID NO: 285; NC_019_43_RecA, SEQ ID NO: 286; NC_021_44_RecA, SEQ ID NO: 287; NC_023_45_RecA, SEQ ID NO: 288; NC_025_46_RecA, SEQ ID NO: 289) with the region 720-1191 of the RecA gene from ATTCC11828 strain (RecA 11828, SEQ ID NO: 276). Shaded areas indicated nucleotide base identity at the same base position.

The RecA gene sequenced from the putative RT6 clones aligns with the region 720-1191 of the RecA gene from ATTCC11828 strain (FIG. 11). The alignment with the type I strain, NCTC 737, shows 5 bp variations indicating that the colonies are of type II strains.

Additionally, the RecA gene sequenced from the putative RT6 clones aligns with the region 64-325 of the RecA gene from ATTCC11828 strain (SEQ ID NO: 276). The alignment with the type I strain, NCTC 737 (SEQ ID NO: 277), shows 3 bp variations indicating that the colonies are of type II strains.

Figure 12:
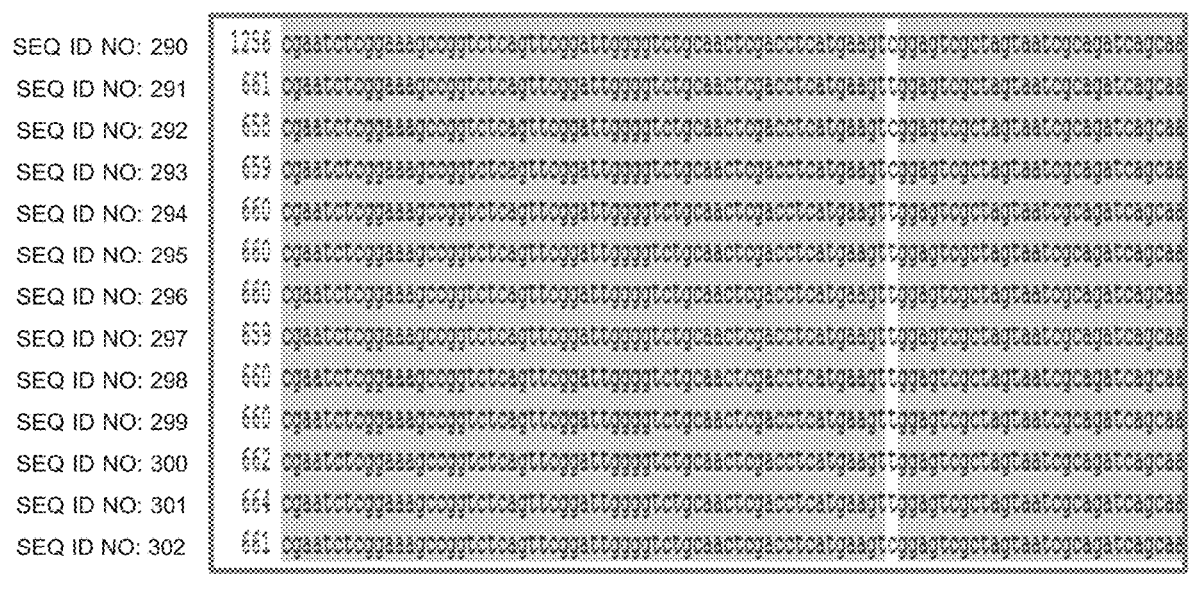

SNP sequences for ATCC 1828 aligned with RT6 SNP sequence from literature and 9 isolates (C→T at 1315)(FIG. 12). Nine of the isolated strains from our studies match the RT6 SNP sequence as published (e.g., Fitz-Gibbon, S., et al., (2013) *Invest. Dermatol.*, 133(9):2152-60).

Figure 13:
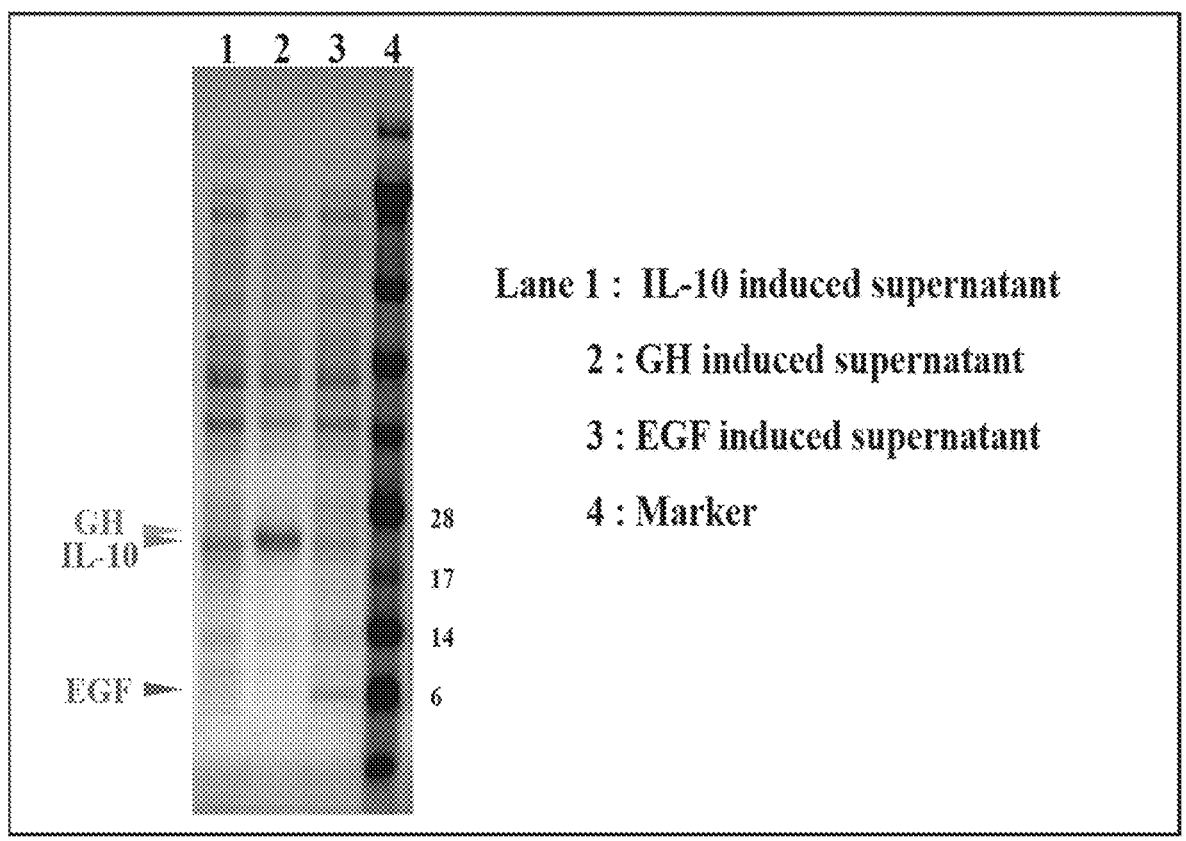
FIG. 13 shows a protein expression of human IL-10 (lane 1, IL-10), human growth hormone (lane 2, GH) and human epidermal growth factor (lane 3, EGF) in the growth media of individual genetically modified *P. acnes* strains. The indicated proteins were expressed under the direction of inducible LacZ promoters.
Figure 14:
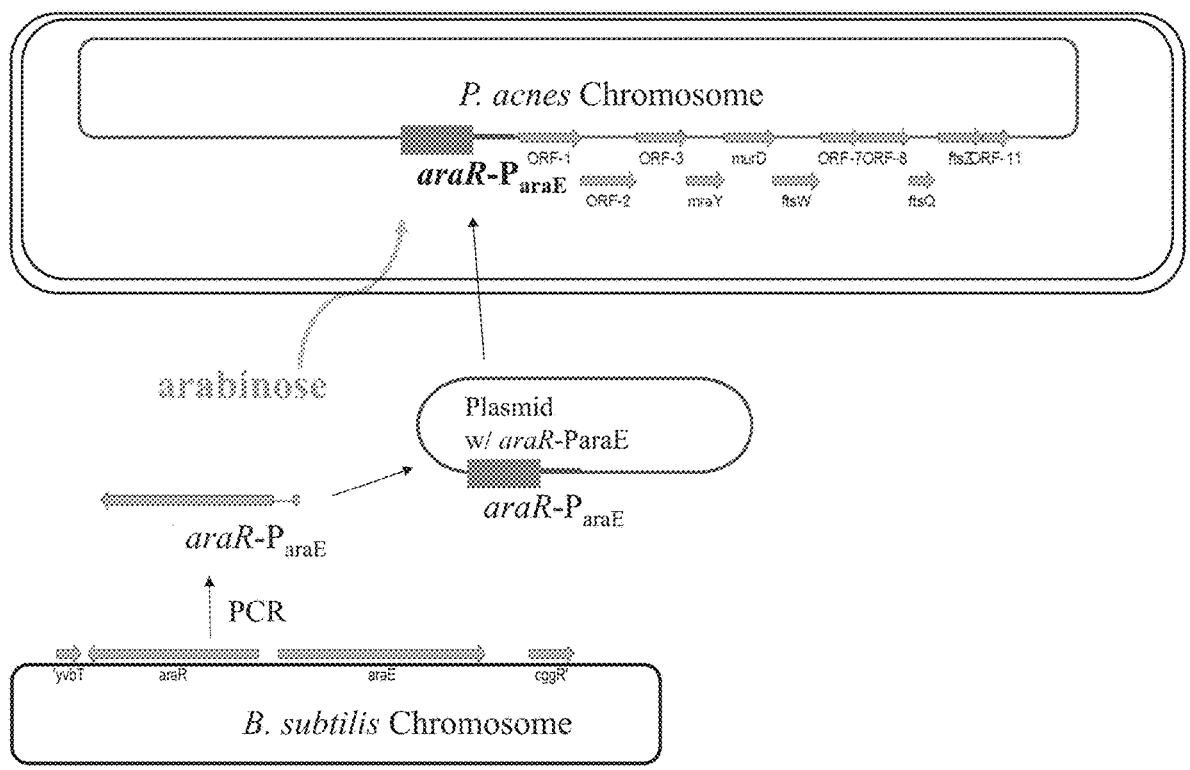
FIG. 14 shows a scheme for construction of growth arrest *P. acnes* mutant strain. The DNA region of arabinose inducible promoter and regulator was amplified from *B. subtilis* and the fragment of fts operon was ligated to the downstream of arabinose inducible promoter. This plasmid was introduced into *P. acnes* for single crossover recombination to construct arabinose regulated growth arrest strain.
Figure 15:
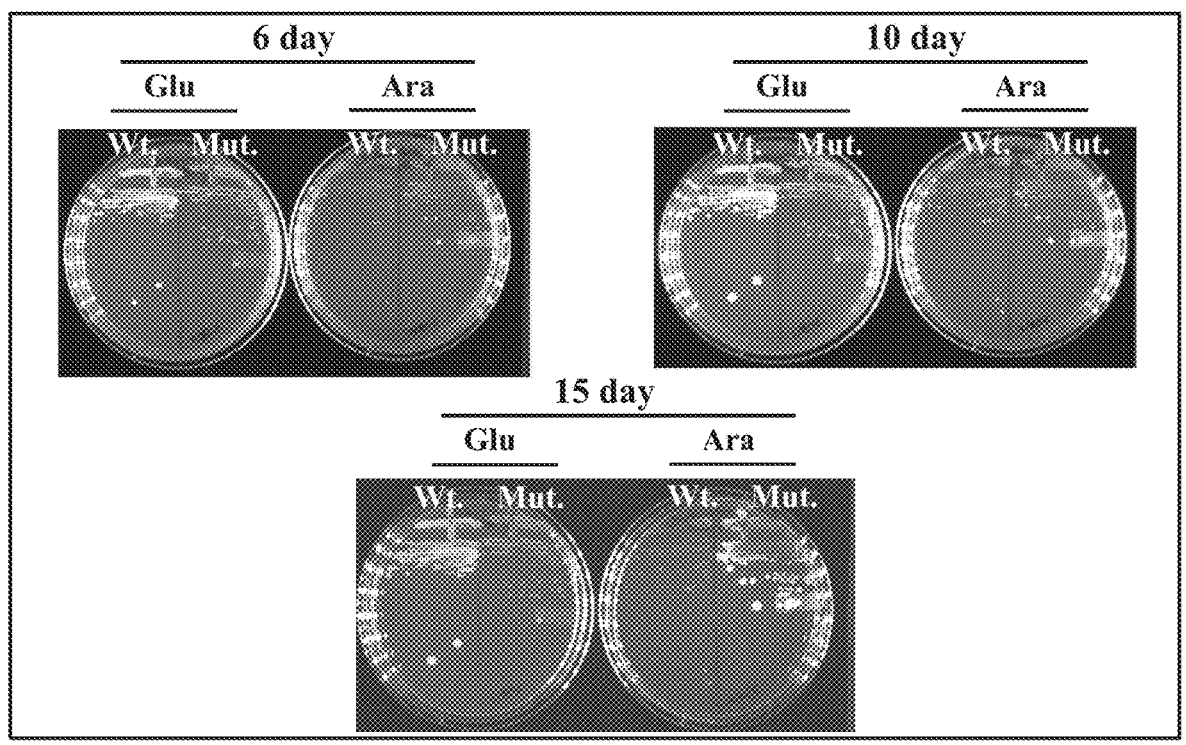
FIG. 15 shows growth comparison of *P. acnes* wild type and growth arrest mutant strain. *P. acnes* wild type strain and growth arrest mutant strain were streaked onto the modified reinforced *clostridium* media with glucose (1%) and arabinose (1.5%) and incubated at 37° C. under anaerobic condition. The colony sizes of these strains were checked on the 6$^{th}$, 10$^{th}$, and 15$^{th}$ days.
Figure 16:
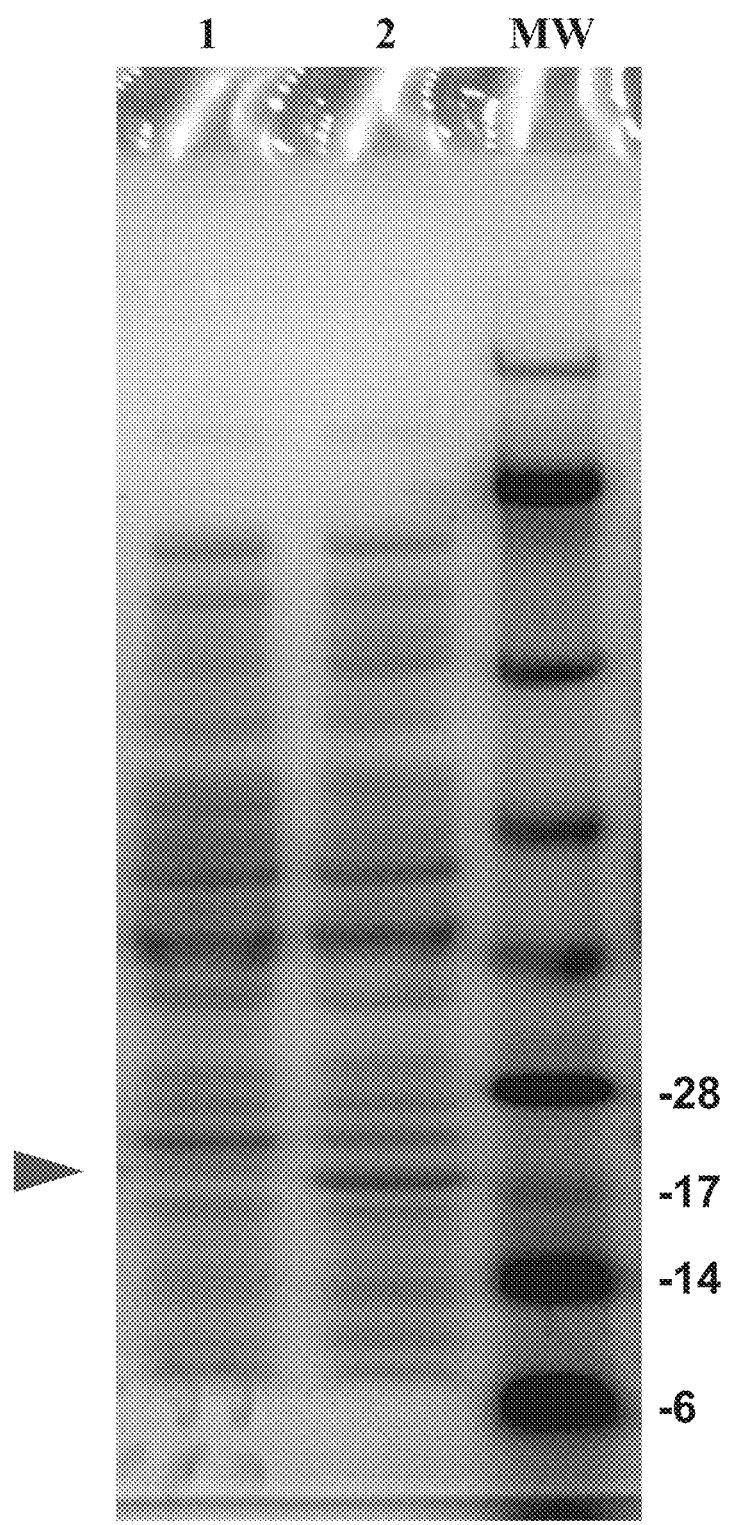
FIG. 16 shows expression of IL-10 (lane 2) in the growth media of a genetically modified *P. acnes* strain induced with 0.1 mM IPTG (isopropyl-beta-D-thiogalactopyranoside) for 1.5 hours. Pre-induced growth media is shown in lane 1.

Example 14. Knock-In of the Human IL-10, EGF and HGH genes into RT6 *P. acnes* strain The genes for human IL-10, human EGF and human GH were all cloned into separate *P. acnes* strains under inducible LacZ promoters. Upon incubation of the cells with 0.1 mM IPTG we began to see expression of the respective genes and secretion into the growth media (FIG. 13).

Example 15. Growth Arrest of *P. acnes* by Introduction of Inducible Promotors to Housekeeping Genes Growth of the *P. acnes* was only achievable upon induction by IPTG (Table 3). The same constructs are being made with an arabinose inducible promoter so that the human gene secretion and growth arrest can be controlled by separate nutrients.

TABLE 3

| | Incubation time | | |
|---|---|---|---|
| IPTG (mM) | 1 day | 2 day | 5 day |
| 0 | − | − | − |
| 0.05 | − | − | − |
| 0.10 | +/−* | +* | ++* |
| 0.25 | +/−* | +/−* | +* |

Example 16. Construction of CAMPII Mutant and IL-10 Expression Strain of *P. acnes*

The 1100 bp upstream region from CAMPII ORF of *P. acnes* (Primers Up-C F and Up-C R), and 400 bp of truncated CAMPII ORF (Primers CAMPII F and CAMPII R) were amplified by PCR with genome DNA of *P. acnes*

ATCC 11828 strain. For secretion of IL10, the 168 bp of the signal peptide region was by PCR with the genome DNA of *B. subtilis* strain 168 as a template (Primers Sig-C F and Sig-C R). The 568 bp of human IL10 ORF was amplified by PCR (Primers 110-C F and 110-C R). These PCR products and DNA fragment with erythromycin resistance genes were ligated with pUC19 by NEBuilder HiFi DNA Assembly Cloning Kit and transformants of this ligation product were selected on LB with amp (100 µg/mL) plate. After transformation into *E. coli* dcm- dam-strain, the plasmid was introduced into *P. acnes* and selected anaerobically on reinforced clostridial medium (RCM) with erm (5 µg/mL) plates. The transformant having IL-10 gene with CAMPII promoter and signal peptide was checked by PCR. For construction of CAMPII mutant strain, this transformant was cultured in RCM without erythromycin to allow the second homologous recombination. After streak on the plate, the CAMPII mutant colonies were screened by PCR.

TABLE 4

List of primers

| Name | Sequences (5'-3') |
|---|---|
| 19-C F | GAATTCGAGCTCGGTACC (SEQ ID NO: 250) |
| 19-C R | ACTGGCCGTCGTTTTACAAC (SEQ ID NO: 251) |
| Up-CF | GTTGTAAAACGACGGCCAGTGAAGGCACCCATGAGCCT (SEQ ID NO: 252) |
| Up-C R | TTGCAAACATAAAGGTTCTCCGTTTATTGGTTG (SEQ ID NO: 253) |
| Sig-C F | GAGAACCTTTATGTTTGCAAAACGATTCAAAAC (SEQ ID NO: 254) |
| Sig-C R | AGGAGTGCATATGATAAATAGACATGGTTCCG (SEQ ID NO: 255) |
| I10-C F | CTATTTATCATATGCACTCCTCCGCTCTG (SEQ ID NO: 256) |
| I10-C R | GGGTCTTCTTCATTCAGTTGCGGATCTTCATGG (SEQ ID NO: 257) |
| CAMPII F | CCGCAACTGAATGAAGAAGACCCATCTTG (SEQ ID NO: 258) |
| CAMPII R | TAGAGACTGGGGACCTTGTTTTGGAGAG (SEQ ID NO: 259) |
| Erm-C F | AACAAGGTCCCCAGTCTCTAGAATCGGATAATAAATATATATAAAC (SEQ ID NO: 260) |
| Erm-C R | CGGGTACCGAGCTCGAATTCCGATTATCTAGACAGCTCC (SEQ ID NO: 261) |

Example 17. Construction of GAPDH Mutant and IL-10 Expression Strain of *P. acnes*

The 1000 bp upstream region from GAPDH ORF of *P. acnes* (Primers Up-G F and Up-G R), and 400 bp of truncated GAPDH ORF (Primers Gapdh F and gapdh R) were amplified by PCR with genome DNA of *P. acnes* ATCC 11828 strain. For secretion of IL10, the 168 bp of the signal peptide region was by PCR with the genome DNA of *B. subtilis* strain 168 as a template (Primers Sig-G F and Sig-G R). The 568 bp of human IL10 ORF was amplified by PCR (Primers 110-G F and 110-G R). These PCR products and DNA fragment with erythromycin resistance genes were ligated with pUC19 by NEBuilder HiFi DNA Assembly Cloning Kit and transformants of this ligation product were selected on LB with amp (100 µg/mL) plate. After transformation into *E. coli* dcm- dam-strain, the plasmid was introduced into *P. acnes* and selected anaerobically on reinforced clostridial medium (RCM) with erm (5 µg/mL) plates. The transformant having IL-10 gene with GAPDH promoter and signal peptide was checked by PCR. For construction of GAPDH mutant strain, this transformant was cultured in modified RCM (m-RCM) with lactate and without erythromycin to allow the second homologous recombination. After streak on the m-RCM with lactate and RCM plates, colonies that grew only on the m-RCM with lactate were picked and these mutants were checked by PCR.

TABLE 5

List of primers

| Name | Sequences (5'-3') |
|---|---|
| 19-G F | GAATTCGAGCTCGGTACC (SEQ ID NO: 262) |
| 19-G R | ACTGGCCGTCGTTTTACAAC (SEQ ID NO: 263) |
| Up-G F | GTTGTAAAACGACGGCCAGTTCGTCAATGGCGCTGGAC (SEQ ID NO: 264) |
| Up-G R | TTGCAAACATTAAGGGATCTCCTCCAAATGAG (SEQ ID NO: 265) |
| Sig-G F | AGATCCCTTAATGTTTGCAAAACGATTCAAAAC (SEQ ID NO: 266) |
| Sig-G R | AGGAGTGCATATGATAAATAGACATGGTTCCG (SEQ ID NO: 267) |
| I10-G F | CTATTTATCATATGCACTCCTCCGCTCTG (SEQ ID NO: 268) |
| I10-G R | TGACGGTCATTCAGTTGCGGATCTTCATGG (SEQ ID NO: 269) |
| Gapdh F | CCGCAACTGAATGACCGTCAAGGTTGGTATC (SEQ ID NO: 270) |
| Gapdh R | TAGAGACTGGCCATAACGAAGGTGCCGTC (SEQ ID NO: 271) |
| Erm-G F | TTCGTTATGGCCAGTCTCTAGAATCGGATAATAAATATATATAAAC (SEQ ID NO: 272) |
| Erm-G R | CGGGTACCGAGCTCGAATTCCGATTATCTAGACAGCTCC (SEQ ID NO: 273) |

Example 18. Skin Probiotic Formulation with *P. acnes*, Type II, Ribotype 6 (Type II R6 *P. acnes*)

As disclosed herein, base strain of *P. acnes* has been modified by introducing inducible promoters (arabinose) for genes FtsZ and DnaA both separately and together (Xyc-F01, Xyc-D01 and Xyc-FD01). This results in strains that do not propagate without the presence of arabinose in its environment. However, the strains still are viable and metabolize without arabinose, as the modified genes are not essential for viability.

A topical formulation could include one of the growth arrested strains (Xyc-F01, Xyc-D01 and Xyc-FD01) alone, or in combination with native 44-1 (*P. acnes* Type II R6, isolated from the face of a human), that has not been genetically modified to include, for example, a nucleic acid encoding a mammalian growth factor or a mammalian cytokine or a mammalian vasodilator or an interleukin-1 receptor (IL-1R) antagonist. Such a formulation would be expected to provide benefits as follows:

Humans have a mixture of an array of microbes on their skin (e.g., face), some commensal and some pathogenic. When commensal microbes are out-competed by pathogenic microbes, maladies may arise due to dysbiosis. Maladies include inflammatory skin diseases such as acne, psoriasis and dermatitis. In addition, these maladies may have a human genetic component as well, such as predisposition to inflammation Topically administering/applying the commensal strain(s) of *P. acnes* on the skin (e.g., face), for example, on a daily basis, will allow the commensal strain(s) to compete for resources in the skin, and by repeated administration/application the commensal strain is replenished. Additionally the secretome of the commensal bacteria will transform the environment of the skin to favor commensal bacteria and this will lead to a shift in the microbiota of the skin (e.g., face) to occur.

As the secretome of the commensal *P. acnes* is beneficial, large amounts are expected to provide benefit by helping to out-compete the pathogenic stains. This results in an environment where *P. acnes* can thrive, and pathogenic strains cannot (e.g. *Staphylococcus*).

More specifically, metabolism of *P. acnes* can lower pH of the skin (e.g., face), which staph species do not thrive in. Hyaluronidase secretion by *P. acnes* can degrade staph cell walls. Though thought to be a pathogen initially, certain strains of *P. acnes*, such as 44-1, have a secretome with anti-inflammatory properties which can reduce skin inflammation as measured by reduction of inflammatory cytokine secretion.

To not constantly overwhelm the skin (e.g., face), with large amounts of exponentially propagating bacteria, a proportion of the mixture will consist of growth arrested strains, such as *P. acnes*, which can produce the beneficial secretome that can help maintain the commensal environment without creating an issue of overgrowth. Typical proportions of growth arrested strains, such as *P. acnes*, in such a combination will be 50% or less compared with native strain (e.g., *P. acnes*, Type II R6), that has not been genetically modified.

Example 19. Supernatant from Strain 44-1 (*P. acnes* Type II R6, Isolated from the Face of a Human) Reduces the Upregulation of TNFα by LPS Total RNA from cells were extracted using Trizol (Sigma Aldrich) and cDNA was generated using the SuperScript IV First Strand cDNA Synthesis kit (Invitrogen). cDNA was quantified on StepOne Plus qPCR/Real-Time PCR system (Applied Biosystems). Gene expression data were presented relative to the expression of housekeeping gene GAPDH. TNF-α forward primer: GAGGCCAAGCCCTGGTATG (SEQ ID NO: 303)/TNF-α reverse primer: CGGGCCGAT-TGATCTCAGC (SEQ ID NO: 304). GAPDH forward primer: AAGGTGAAGGTCGGAGTCAACG (SEQ ID NO: 305)/GAPDH reverse primer: CCTTCTC-CATGGTGGTGAAGAC (SEQ ID NO: 306).

Figure 17:
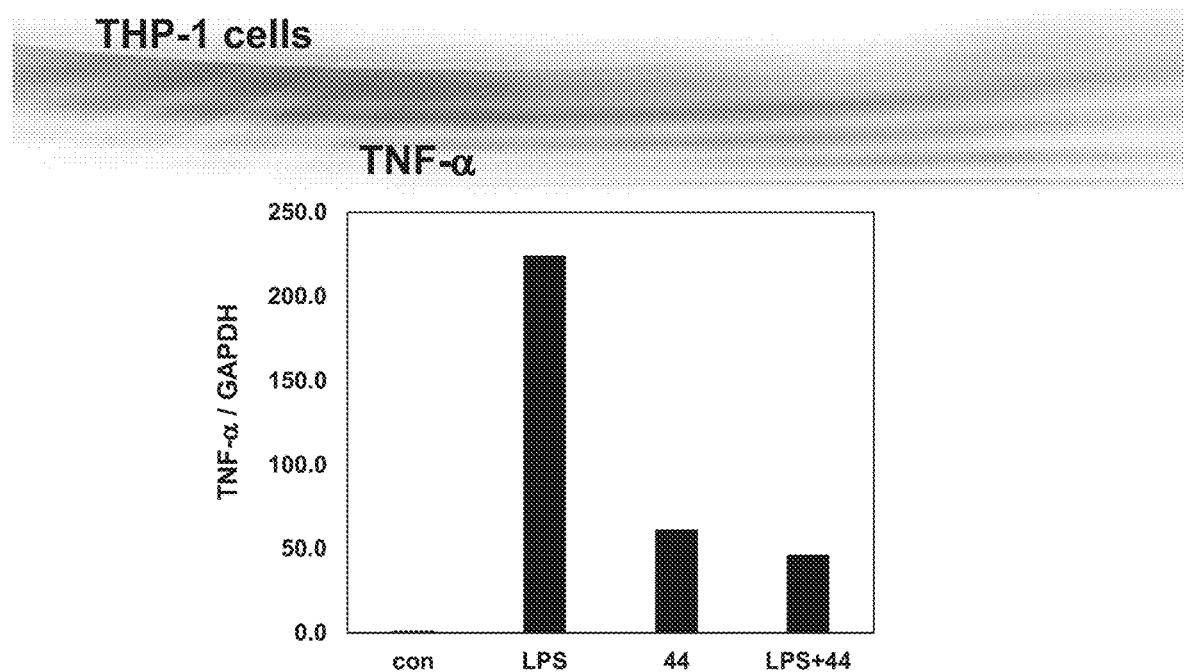
FIG. 17 shows that supernatant from a culture of *P. acnes* Type II can significantly mute the upregulation of TNFα by LPS. Real-time quantitative PCR analysis.

The data in FIG. 17 show that upregulation of the inflammatory cytokine TNF-α occurs upon stimulation with Lipopolysaccharide (LPS; lane 2). This reaction is somewhat inhibited by the anti-inflammatory cytokine Interleukin 10 (IL-10; lane 5), while IL-10 itself does not show an effect on TNF-α upregulation (lane 3). In like manner, the supernatant of a culture of *P. acnes* Type II R6 (44-1, lane 4 and 6) can significantly reduce the upregulation of TNF-α by LPS (lane 6); although it appears to instigate slight upregulation of the TNF-α transcript alone (lane 4). This data suggests that while the secretome of the *P. acnes* Type II strain (44) may have some slight inflammatory qualities, it may confer protection for human cells from excessive bacterial-related inflammation via substances such as LPS.

Example 20. References

Sörensen M, M. T. (2010). Mutagenesis of *Propionibacterium acnes* and analysis of two CAMP factor knock-out mutants. J Microbiol Methods, 211-216.

Rhee M S, Moritz B E, Xie G, Glavina Del Rio T, Dalin E, Tice H, Bruce D, Goodwin L, Chertkov O, Brettin T, Han C, Detter C, Pitluck S, Land M L, Patel M, Ou M, Harbrucker R, Ingram L O, Shanmugam K T. (2011). Complete Genome Sequence of a thermotolerant sporogenic lactic acid bacterium, *Bacillus coagulans* strain. Standards in Genomic Sciences 5,331-340.

Rhee M S, Kim J W, Qian Y L, Ingram L O, Shanmugam K T. (2007). Development of plasmid vector and electroporation condition for gene transfer in sporogenic lactic acid bacterium, *Bacillus coagulans*. Plasmid 58:13-22.

Cheong D E, Lee H I, So J S. (2008). Optimization of electrotransformation conditions for *Propionibacterium acnes*. J Microbiol Methods. 72(1):38-41.

Rhee M S, Wei L, Sawhney N, Rice J D., St. John F, Hurlbert, J C, Preston, J F. (2014). Engineering the xylan utilization system in *Bacillus subtilis* for production of acidic xylooligosaccharides. Appl. Environ. Microbiol. 80 (3) 917-927.

REPRESENTATIVE NON-LIMITING EMBODIMENTS

A1. A method of making a nucleic acid for controlled expression of a peptide for treatment comprising providing a first nucleic acid sequence encoding an operon sequence for controlled expression;
joining the first nucleic acid sequence to a second nucleic acid sequence encoding a first peptide; and optimizing the nucleic acid for controlled expression of a peptide for treatment for protein expression.

A2. The method of embodiment A1, wherein the operon is a prokaryotic operon.

A3. The method of embodiment A2, wherein the operon is a lac operon.

A4. The method of embodiment A2, wherein the operon is a Trp operon.

A5. The method of embodiment A1, wherein the operon is a eukaryotic operon.

A6. The method of any one of embodiments A1-A5, wherein the first peptide comprises a hyaluronan synthase, or portion thereof.

A7. The method of embodiment A6, wherein the hyaluronan synthase, or portion thereof comprises a sequence of SEQ ID NO: 1, SEQ ID NO: 2, SEQ ID NO: 3, or SEQ ID NO: 4.

A8. The method of any of embodiments A1-A5, wherein the first peptide comprises elastin, or a portion thereof.

A9. The method of embodiment A8, wherein the elastin, or a portion thereof comprises a sequence of SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, or SEQ ID NO: 17.

A10. The method of any of embodiments A1-A5, wherein the first peptide comprises collagen, or a portion thereof.

A11. The method of embodiment A10, wherein the collagen, or a portion thereof comprises a sequence of SEQ ID NO: 18, SEQ ID NO: 19, SEQ ID NO: 20, SEQ ID NO: 21, SEQ ID NO: 22, or SEQ ID NO: 23.

A12. The method of any of embodiments A1-A5, wherein the first peptide comprises an anti-inflammatory, or a portion thereof.

A13. The method of embodiment A12, wherein the anti-inflammatory is an interleukin, or a portion thereof.

A14. The method of embodiment A12 or A13, wherein the anti-inflammatory, or portion thereof comprises a sequence of SEQ ID NO: 24, SEQ ID NO: 25, SEQ ID NO: 26, SEQ ID NO: 27, or SEQ ID NO: 28.

A15. The method of any one of embodiments A1-A5, wherein the first peptide comprises a clotting factor, or portion thereof.

A16. The method of embodiment A15, wherein the clotting factor, or portion thereof comprises the sequence of SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, or SEQ ID NO: 39.

A17. The method of any one of embodiments A1-A5, wherein the first peptide comprises an enzyme for melanin synthesis, or portion thereof.

A18. The method of embodiment A17, wherein the enzyme for melanin synthesis, or portion thereof comprises the sequence of SEQ ID NO: 40, SEQ ID NO: 41, SEQ ID NO: 42, SEQ ID NO: 43, or SEQ ID NO: 44.

A19. The method of any of embodiments A1-A5, wherein the first peptide comprises a hormone, or portion thereof.

A20. The method of embodiment A19, wherein the hormone, or portion thereof comprises the sequence of SEQ ID NO: 45, SEQ ID NO: 46, SEQ ID NO: 47, SEQ ID NO: 48, or SEQ ID NO: 49.

A21. The method of any of embodiments A1-A5, wherein the first peptide comprises a platelet basic protein, or portion thereof.

A22. The method of embodiment A21, wherein the platelet basic protein, or portion thereof comprises the sequence of SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, or SEQ ID NO: 62.

A23. The method of any of embodiments A1-A5, wherein the first peptide comprises a transforming growth factor, or portion thereof.

A24. The method of embodiment A23, wherein the transforming growth factor, or portion thereof comprises the sequence of SEQ ID NO: 63, SEQ ID NO: 64, SEQ ID NO: 65, SEQ ID NO: 66, SEQ ID NO: 67, SEQ ID NO: 68, or SEQ ID NO: 69.

A25. The method of any one of embodiments A1-A5, wherein the first peptide comprises a hepatocyte growth factor, or portion thereof.

A26. The method of embodiment A25, wherein the hepatocyte growth factor, or portion thereof comprises the sequence of SEQ ID NO: 70.

A27. The method of any one of embodiments A1-A5, wherein the first peptide comprises a vascular endothelial growth factor, or portion thereof.

A28. The method of embodiment A27, wherein the vascular endothelial growth factor, or portion thereof comprises the sequence of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, or SEQ ID NO: 91.

A29. The method of any of embodiments A1-A5, wherein the first peptide comprises a placental growth factor, or portion thereof.

A30. The method of embodiment A29, wherein the placental growth factor, or portion thereof comprises the sequence of SEQ ID NO: 92.

A31. The method of any of embodiments A1-A5, wherein the first peptide comprises a platelet derived growth factor, or portion thereof.

A32. The method of embodiment A31, wherein the platelet derived growth factor, or portion thereof comprises the sequence of or SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, or SEQ ID NO: 102.

A33. The method of any of embodiments A1-A5, wherein the first peptide comprises an epidermal growth factor, or portion thereof.

A34. The method of embodiment A33, wherein the epidermal growth factor, or portion thereof comprises the sequence of SEQ ID NO: 103, SEQ ID NO: 104, SEQ ID NO: 105, or SEQ ID NO: 106.

A35. The method of any one of embodiments A1-A5, wherein the first peptide comprises a fibroblast growth factor, or portion thereof.

A36. The method of embodiment A35, wherein the fibroblast growth factor, or portion thereof comprises the sequence of SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, or SEQ ID NO: 144.

A37. The method of any one of embodiments A1-A5, wherein the first peptide comprises a DNA repair enzyme, or portion thereof.

A38. The method of embodiment of A37, wherein the DNA repair enzyme or portion thereof is derived from a base excision repair enzyme.

A39. The method of any of embodiment A37 or A38, wherein the DNA repair enzyme, or portion thereof comprises the amino acid sequence of SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, or SEQ ID NO: 155.

A40. The method of embodiment A37, wherein the DNA repair enzyme or portion thereof is derived from an enzyme for direct reversal of damage.

A41. The method of embodiment A37 or A40, wherein the enzyme for direct reversal of damage comprises the amino acid sequence of SEQ ID NO: 156, SEQ ID NO: 157, or SEQ ID NO: 158.

A42. The method of embodiment A37, wherein the DNA repair enzyme or portion thereof is derived from a mismatch excision repair enzyme.

A43. The method of embodiment A37 or A42, wherein the mismatch excision repair enzyme comprises the amino acid sequence of SEQ ID NO: 159, SEQ ID NO: 160 SEQ ID NO: 161, SEQ ID NO: 162, SEQ ID NO: 163, SEQ ID NO: 164, SEQ ID NO: 165, SEQ ID NO: 166, SEQ ID NO: 167 or SEQ ID NO: 168.

A44. The method of embodiment A37, wherein the DNA repair enzyme or portion thereof is derived from a nucleotide excision repair enzyme.

A45. The method of embodiment A37 or A44, wherein the nucleotide excision repair enzyme comprises an amino acid sequence of SEQ ID NO: 169, SEQ ID NO: 170 SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180 SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190 SEQ ID NO: 191, SEQ ID NO: 192, SEQ ID NO: 193, SEQ ID NO: 194, SEQ ID NO: 195, SEQ ID NO: 196, or SEQ ID NO: 197.

A46. The method of embodiment A37, wherein the DNA repair enzyme or portion thereof is derived from an editing or processing nuclease.

A47. The method of embodiment A37 or A46, wherein the editing or processing nuclease comprises an amino acid sequence of SEQ ID NO: 198, SEQ ID NO: 199, SEQ ID NO: 200 SEQ ID NO: 201, SEQ ID NO: 202, SEQ ID NO: 203, SEQ ID NO: 204, or SEQ ID NO: 205.

A48. The method of any of embodiments A1-A5, wherein the first peptide comprises a telomerase, or portion thereof.

A49. The method of embodiment A48, wherein the telomerase or portion thereof comprises an amino acid sequence of SEQ ID NO: 206, SEQ ID NO: 207, SEQ ID NO: 208, or SEQ ID NO: 209.

A50. The method of any one of embodiments A1-A5, wherein the first peptide comprises a protection of telomerase protein 1, or portion thereof.

A51. The method of embodiment A50, wherein the protection of telomerase protein 1, or portion thereof comprises an amino acid sequence of SEQ ID NO: 210 or SEQ ID NO: 211.

A52. The method of anyone of embodiments A1-A5, A8-A16 or A19-A51, further comprising providing a third nucleic acid sequence encoding a second peptide and joining the third nucleic acid sequence to the second nucleic acid sequence encoding the first peptide at one end, wherein the third nucleic acid sequence lies between the first nucleic acid sequence encoding the operon sequence and the second nucleic acid sequence encoding the first peptide.

A53. The method of any one of embodiments A1-A5, A8-A16 or A19-A51, further comprising providing a third nucleic acid sequence encoding a second peptide and joining the third nucleic acid sequence to the second nucleic acid sequence encoding the first peptide at one end, wherein the third nucleic acid sequence is at the opposite end of the second nucleic acid sequence from the first nucleic acid sequence encoding the operon sequence.

A54. The method of embodiment A52 or A53, wherein the second peptide comprises SEQ ID NO: 5, SEQ ID NO: 6, SEQ ID NO: 7 SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17 SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27 SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37 SEQ ID NO: 38, SEQ ID NO: 39, SEQ ID NO: 45, SEQ ID NO: 46, SEQ ID NO: 47 SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57 SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67 SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77 SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87 SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107 SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117 SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127 SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137 SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147 SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157 SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167 SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177 SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 106, SEQ ID NO: 187 SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197 SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207 SEQ ID NO: 208, SEQ ID NO: 209, SEQ ID NO: 210, or SEQ ID NO: 211 and wherein the second peptide does not comprise the amino acid sequence of the first peptide.

A55. The method of any of embodiments A1-A5, A8-A16 or A19-A51, further comprising providing a nucleic acid sequence encoding a secretory peptide and joining said nucleic acid sequence encoding the secretory peptide to the nucleic acid sequence encoding the operon at one end, wherein the nucleic acid encoding the secretory peptide lies between operon sequence and second nucleic acid sequence encoding the first peptide.

A56. The method of any of embodiments A1-A5, A8-A16 or A19-A51, further comprising providing a nucleic acid sequence encoding a secretory peptide and joining said nucleic acid sequence to the nucleic acid sequence encoding the second nucleic acid sequence encoding the first peptide at one end wherein the nucleic acid sequence encoding a secretory peptide is at an opposite end of the nucleic acid sequence encoding the operon.

A57. The method of any of embodiments A52-A54, further comprising providing a nucleic acid sequence encoding a secretory peptide and joining the nucleic acid sequence encoding the secretory peptide to the nucleic acid sequence encoding the operon at one end, wherein the nucleic acid encoding the secretory peptide lies between the operon sequence and second nucleic acid sequence encoding the first peptide or the third nucleic acid sequence encoding the second peptide.

A58. The method of any of embodiments A52-A54, further comprising providing a nucleic acid sequence encoding a secretory peptide and joining the nucleic acid sequence encoding the secretory peptide to the nucleic acid sequence encoding the second nucleic acid sequence encoding the first peptide or joining the nucleic acid sequence encoding the secretory peptide to the nucleic acid sequence encoding the third nucleic acid sequence encoding the second peptide at one end, wherein the nucleic acid sequence encoding the secretory peptide is at an opposite end of the operon sequence.

A59. The method of any one of embodiments A55-A58, wherein the secretory peptide comprises the sequence SEQ ID NO: 212, SEQ ID NO: 213, SEQ ID NO: 214, SEQ ID NO: 215 or SEQ ID NO: 216.

A60. The method of any one of embodiments A1-A59, wherein the optimizing is performed by computational methods.

A61. A nucleic acid nucleic acid for controlled expression of a peptide for treatment comprising a first nucleic acid sequence encoding an operon sequence for controlled expression; a second nucleic acid sequence encoding a first peptide; and wherein the nucleic acid nucleic acid for controlled expression of a peptide for treatment is optimized for protein expression.

A62. The nucleic acid of embodiment A61, wherein the operon is a prokaryotic operon.

A63. The nucleic acid of embodiment A61 or A62, wherein the operon is a lac operon.

A64. The nucleic acid of embodiments A61 or A62, wherein the operon is a Trp operon.

A65. The nucleic acid of embodiment A61, wherein the operon is a eukaryotic operon.

A66. The nucleic acid of any one of embodiments A61-A65, wherein the first peptide comprises a hyaluronan synthase, or portion thereof.

A67. The nucleic acid of embodiment A66, wherein the first peptide comprises a sequence of SEQ ID NO: 1, SEQ ID NO: 2, SEQ ID NO: 3, or SEQ ID NO: 4.

A68. The nucleic acid of any of embodiments A61-A65, wherein the first peptide comprises elastin, or a portion thereof.

A69. The nucleic acid of embodiment A68, wherein the first peptide comprises a sequence of SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, or SEQ ID NO: 17.

A70. The nucleic acid of any one of embodiments A61-A65, wherein the first peptide comprises collagen, or a portion thereof.

A71. The nucleic acid of embodiment A70, wherein the first peptide comprises a sequence of SEQ ID NO: 18, SEQ ID NO: 19, SEQ ID NO: 20, SEQ ID NO: 21, SEQ ID NO: 22, or SEQ ID NO: 23.

A72. The nucleic acid of any one of embodiments A61-A65, wherein the first peptide comprises an anti-inflammatory, or a portion thereof.

A73. The nucleic acid of embodiment A72, wherein the anti-inflammatory is an interleukin, or a portion thereof.

A74. The nucleic acid of any one of embodiments A72 or A73, wherein the first peptide comprises a sequence of SEQ ID NO: 24, SEQ ID NO: 25, SEQ ID NO: 26, SEQ ID NO: 27, or SEQ ID NO: 28.

A75. The nucleic acid of any one of embodiments A61-A65, wherein the first peptide comprises a clotting factor, or portion thereof.

A76. The nucleic acid of embodiment A75, wherein the first peptide comprises the sequence of SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, or SEQ ID NO: 39.

A77. The nucleic acid of any one of embodiments A61-A65, wherein the first peptide comprises an enzyme for melanin synthesis, or portion thereof.

A78. The nucleic acid of embodiment A77, wherein the first peptide comprises the sequence of SEQ ID NO: 40, SEQ ID NO: 41, SEQ ID NO: 42, SEQ ID NO: 43 or SEQ ID NO: 44.

A79. The nucleic acid of any one of embodiments A61-A65, wherein the first peptide comprises a hormone, or portion thereof.

A80. The nucleic acid of embodiment A79, wherein the first peptide for treatment comprises the sequence of SEQ ID NO: 45, SEQ ID NO: 46, SEQ ID NO: 47, SEQ ID NO: 48 or SEQ ID NO: 49.

A81. The nucleic acid of any one of embodiments A61-A65, wherein the first peptide comprises a platelet basic protein, or portion thereof.

A82. The nucleic acid of embodiment A81, wherein the first peptide comprises the sequence of SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, or SEQ ID NO: 62.

A83. The nucleic acid of any one of embodiments A61-A65, wherein the first peptide comprises a transforming growth factor, or portion thereof.

A84. The nucleic acid of embodiment A83, wherein the first peptide comprises the sequence of SEQ ID NO: 63, SEQ ID NO: 64, SEQ ID NO: 65, SEQ ID NO: 66, SEQ ID NO: 67, SEQ ID NO: 68, or SEQ ID NO: 69.

A85. The nucleic acid of any one of embodiments A61-A65, wherein the first peptide comprises a hepatocyte growth factor, or portion thereof.

A86. The nucleic acid of embodiment A85, wherein the first peptide comprises the sequence of SEQ ID NO: 70.

A87. The nucleic acid of any one of embodiments A61-A65, wherein the first peptide comprises a vascular endothelial growth factor, or portion thereof.

A88. The nucleic acid of embodiment A87, wherein the first peptide comprises the sequence of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, or SEQ ID NO: 91.

A89. The nucleic acid of any one of embodiments A61-A65, wherein the first peptide comprises a placental growth factor, or portion thereof.

A90. The nucleic acid of embodiment A89, wherein the first peptide comprises the sequence of SEQ ID NO: 92.

A91. The nucleic acid of any one of embodiments A61-A65, wherein the first peptide comprises a platelet derived growth factor, or portion thereof.

A92. The nucleic acid of embodiment A91, wherein the first peptide comprises the sequence of SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, or SEQ ID NO: 102.

A93. The nucleic acid of any one of embodiments A61-A65, wherein the first peptide comprises an epidermal growth factor, or portion thereof.

A94. The nucleic acid of embodiment A93, wherein the first peptide comprises the sequence of SEQ ID NO: 103, SEQ ID NO: 104, SEQ ID NO: 105, or SEQ ID NO: 106.

A95. The nucleic acid of any one of embodiments A61-A65, wherein the first peptide comprises a fibroblast growth factor, or portion thereof.

A96. The nucleic acid of embodiment A96, wherein the first peptide comprises the sequence of SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, or SEQ ID NO: 144.

A97. The nucleic acid of any one of embodiments A61-A65, wherein the first peptide comprises a DNA repair enzyme, or portion thereof.

A98. The nucleic acid of embodiment of A97, wherein the DNA repair enzyme or portion thereof is derived from a base excision repair enzyme.

A99. The nucleic acid of any of embodiment A97 or A98, wherein the DNA repair enzyme comprises the amino acid sequence of SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, or SEQ ID NO: 155.

A100. The nucleic acid of embodiment A97, wherein the DNA repair enzyme or portion thereof is derived from an enzyme for direct reversal of damage.

A101. The nucleic acid of embodiment A97 or A100, wherein the DNA repair enzyme comprises the amino acid sequence of SEQ ID NO: 156, SEQ ID NO: 157, or SEQ ID NO: 158.

A102. The nucleic acid of embodiment A97, wherein the DNA repair enzyme or portion thereof is derived from a mismatch excision repair enzyme.

A103. The nucleic acid of embodiment A97 or A103, wherein the DNA repair enzyme comprises the amino acid sequence of SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, or SEQ ID NO: 168.

A104. The nucleic acid of embodiment A97, wherein the DNA repair enzyme or portion thereof is derived from a nucleotide excision repair enzyme.

A105. The nucleic acid of embodiment A97 or A104, wherein the DNA repair enzyme comprises an amino acid sequence of SEQ ID NO: 169, SEQ ID NO: 170 SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180 SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190 SEQ ID NO: 191, SEQ ID NO: 192, SEQ ID NO: 193, SEQ ID NO: 194, SEQ ID NO: 195, SEQ ID NO: 196, or SEQ ID NO: 197.

A106. The nucleic acid of embodiment A97, wherein the DNA repair enzyme or portion thereof is derived from an editing or processing nuclease.

A107. The nucleic acid of embodiment A97 or A106, wherein the DNA repair enzyme comprises an amino acid sequence of SEQ NO: 198, SEQ ID NO: 199, SEQ ID NO: 200, SEQ ID NO: 201, SEQ ID NO: 202, SEQ ID NO: 203, SEQ ID NO: 204, or SEQ ID NO: 205.

A108. The nucleic acid of any of embodiments A61-A65, wherein the first peptide comprises a telomerase, or portion thereof.

A109. The nucleic acid of embodiment A108, wherein the telomerase comprises an amino acid sequence of SEQ ID NO: 206, SEQ ID NO: 207, SEQ ID NO: 208, or SEQ ID NO: 209.

A110. The nucleic acid of any one of embodiments A61-A65, wherein the first peptide comprises a protection of telomerase protein 1, or portion thereof.

A111. The nucleic acid of embodiment A110, wherein the protection of telomerase protein 1 comprises an amino acid sequence of SEQ ID NO: 210 or SEQ ID NO: 211.

A112. The nucleic acid of any of embodiments A61-A65, A68-A76 or A79-A111, further comprising a third nucleic acid sequence encoding a second peptide, and wherein the third nucleic acid sequence lies between the first nucleic acid sequence encoding the operon sequence and the second nucleic acid sequence encoding the first peptide.

A113. The nucleic acid of any of embodiments A61-A65, A68-A76 or A79-A111, further comprising a third nucleic acid sequence encoding a second peptide, and wherein the third nucleic acid sequence is attached to the second nucleic acid sequence encoding the first peptide at the opposite end of the first nucleic acid sequence encoding the operon sequence.

A114. The nucleic acid of embodiment A112 or A113, wherein the second peptide comprises SEQ ID NO: 5, SEQ ID NO: 6, SEQ ID NO: 7 SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17 SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27 SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37 SEQ ID NO: 38, SEQ ID NO: 39, SEQ ID NO: 45, SEQ ID NO: 46, SEQ ID NO: 47 SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67 SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77 SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87 SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107 SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117 SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127 SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137 SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147 SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157 SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167 SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177 SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 106, SEQ ID NO: 187 SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197 SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207 SEQ ID NO: 208, SEQ ID NO: 209, SEQ ID NO: 210, or SEQ ID NO: 211 and wherein the second peptide does not comprise the amino acid sequence of the first peptide.

A115. The nucleic acid of any of embodiments A61-A65, A68-A76, or A79-A111, further comprising a nucleic acid sequence encoding a secretory peptide, and wherein the nucleic acid sequence encoding the secretory peptide lies between the operon sequence and second nucleic acid sequence encoding the first peptide.

A116. The nucleic acid of any of embodiments A61-A65, A68-A76, or A79-A111, further comprising a nucleic acid sequence encoding a secretory peptide, and wherein the nucleic acid sequence encoding the secretory peptide is attached to the second nucleic acid sequence encoding the first peptide at one end and is at an opposite end of the operon sequence.

A117. The nucleic acid of any of embodiments A112-A114, further comprising a nucleic acid sequence encoding secretory peptide, and wherein the nucleic acid sequence encoding the secretory peptide is attached to the second nucleic acid sequence encoding the first peptide or the third nucleic acid sequence encoding the second peptide, and wherein the nucleic acid sequence encoding the secretory peptide is between the nucleic acid encoding the operon and the second nucleic acid sequence encoding the first peptide or the third nucleic acid sequence encoding the second peptide.

A118. The nucleic acid of any of embodiments A112-A114, further comprising a nucleic acid sequence encoding secretory peptide, and wherein the nucleic acid sequence encoding the secretory peptide is attached to the second nucleic acid sequence encoding the first peptide or the third nucleic acid sequence encoding the second peptide, and wherein the nucleic acid sequence encoding the secretory peptide is at an opposite end of the nucleic acid encoding the operon.

A119. The nucleic acid of any one of embodiments A115-A118, wherein the signal sequence for secretion comprises the sequence SEQ ID NO: 212, SEQ ID NO: 213, SEQ ID NO: 214, SEQ ID NO: 215, or SEQ ID NO: 216.

A120. The nucleic acid of any one of embodiments A57-A119, wherein the nucleic acid is optimized for protein expression by computational methods.

A121. A cell comprising any one of the nucleic acids set forth in any embodiment or of embodiments A57-A120.

A122. The cell of embodiment A121, wherein the cell comprises a genome with a mutation or gene knockout.

A123. The cell of embodiment A121 or A122, wherein the cell is a bacterial cell.

A124. The cell of embodiment A121 or A122, wherein the cell is a fungal cell.

A125. The cell of any one of embodiments A121-A122, wherein the cell is from a genus *Propionibacterium*.

A126. The cell of any one of embodiments A121-A122, or A125, wherein the cell is *Propionibacterium acnes*.

A127. The cell of any one of embodiments A121-A122, wherein the cell is from a genus *Corynebacterium*.

A128. The cell of any one of embodiments A121-A122, or A127, wherein the cell is *Corynebacterium striatum*.

A129. The cell of any one of embodiments A121-A122, wherein the cell is from a genus *Staphylococcus*.

A130. The cell of any one of embodiments A121-A122, or A129, wherein the cell is *Staphylococcus epidermidis*.

A131. The cell of any one of embodiments A121-A122, wherein the cell is from a genus *Streptococcus*.

A132. The cell of any one of embodiments A121-A122, or A131, wherein the cell is *Streptococcus* thermophiles.

A133. The cell of any one of embodiments A121-A122, wherein the cell is from a genus *Lactobacillus* A134. The cell of any one of embodiments A121-A122, or A133, wherein the cell is *Lactobacillus acidophilus*.

A135. The cell of any one of embodiments A121-A122, wherein the cell if from a genus *Lactococcus*.

A136. The cell of any one of embodiments A121-A122, or A135, wherein the cell is *Lactococcus lactis*.

A137. The cell of any one of embodiments A121-A122, wherein the cell is from a genus Actinobacteria.

A138. The cell of any one of embodiments A121-A122, wherein the cell is from a genus Micrococci.

A139. The cell of any one of embodiments A121-A122, wherein the cell is from a genus *Demodex*.

A140. The cell of any one of embodiments A121-A122, wherein the cell is from a genus *Malassezia*.

A141. The cell of any one of embodiments A121-A122, wherein the cell is from a genus *Escherichia*.

A142. The cell of any one of embodiments A121-A122, or A142 wherein the cell is *Escherichia coli*.

A143. The cell of any one of embodiments A121-A142, wherein the cell is non-pathogenic.

A144. The cell of embodiment A121, A122 or A124, wherein the cell is from a genus *Candida*.

A145. The cell of any one of embodiments A121, A122, A124 or A144 wherein the cell is *Candida albicans*.

A146. The cell of any one of embodiments A121, A122, A124 or A144 wherein the cell is *Candida glabrata*.

A147. The cell of any one of embodiments A121, A122, A124 or A144 wherein the cell is *Candida tropicalis*.

A148. The cell of any one of embodiments A121, A122, A124 or A144 wherein the cell is *Candida parapsilosis*.

A149. The cell of any one of embodiments A121, A122, A124 or A144 wherein the cell is *Candida krusei*.

A150. The cell of any one of embodiments A121-A149, wherein the mutation or knock out is in lipase gene.

A151. The cell of any one of embodiments A121-A149, wherein the mutation or knock out is in a gene encoding for nutrient synthesis.

A152. The cell of any one of embodiments A121-A149, wherein the mutation or knock out is in a gene encoding for a pathogenic biomolecule.

A153. The cell of any one of embodiments A121-A123, A125-A126 or A152, wherein the cell comprises a genome with a mutation or knock out in a gene that encodes for glutamine synthetase.

A154. The cell of any one of embodiments A121-A123, A125-A126 or A152, wherein the cell comprises a genome with a mutation or knock out in a gene that encodes for asparagine synthetase.

A155. The cell of any one of embodiments A121-A123, A125-A126 or A152, wherein the cell comprises a genome with a mutation or knock out in a gene that encodes for aspartokinase.

A156. The cell of any one of embodiments A121-A123, A125-A126 or A152, wherein the cell comprises a genome with a mutation or knock out in a gene that codes for aspartate semialdehyde dehydrogenase.

A157. The cell of any one of embodiments A121-A123, A125-A126 or A152, wherein the cell comprises a genome with a mutation or knock out in a gene that codes for methionine synthesis.

A158. A topical formulation comprising the cell of any one of embodiments A121-A157; and a vehicle for the cell.

A159. A method of treating, inhibiting, or ameliorating a disorder in a subject by delivering controlled expression of a peptide comprising administering to the subject the topical formulation in embodiment A158 for controlled delivery of a peptide.

A160. The method according to embodiment A159, wherein the disorder is acne, rosacea, alopecia, onychomycosis, osmidrosis, greying hair, cutaneous inflammation, dyschromia, aging damage, chronic skin wounds, cutaneous inflammation, nail fungus, an autoimmune disease, or hemophilia.

A161. The method of embodiment A159 or A160 wherein the administering comprises placing the composition on the epidermis.

A162. The method of any one of embodiments A159-A161 further comprising controlling expression of the peptide wherein controlling is performed by administering a second compound.

A163. The method of embodiment A162, wherein the second compound is lactose.

A164. The method of embodiment A162, wherein the second compound is tryptophan.

A165. The method of any one of embodiments A159-A164 further comprising controlling proliferation of a cell, wherein controlling proliferation is performed by administering a third compound.

A166. The method of embodiment A165, wherein the third compound a nutrient.

A167. The method of embodiment A165 or A166, wherein the third compound is an amino acid.

A168. The method of any one of embodiments A165-A67, wherein the third compound is glutamine.

A169. The method of any one of embodiments A165-A67, wherein the third compound is asparagine.

A170. The method of any one of embodiments A165-A67, wherein the third compound is aspartate.

A171. The method of any one of embodiments A165-A67, wherein the third compound is methionine.

B1. Use of a composition comprising a genetically modified bacteria of the genus *Propionibacterium*, as disclosed herein, wherein the bacteria comprises a nucleic acid encoding one or more mammalian growth factors and/or one or more mammalian cytokines, for treatment of a skin or nail disorder of a mammal.

B2. The use of the bacteria of embodiment B1, wherein the mammal is a human, dog or cat.

B3. The use of the bacteria of embodiment B1 or B2, wherein the skin or nail disorder comprises acne, actinic keratosis, alopecia areata, athlete's foot, onychomycosis, atopic dermatitis, osmidrosis, eczema, fungal infection of the nails, psoriasis, rosacea, slow wound healing, folliculitis, keratosis pilaris, perioral dermatitis, angiofibromas, cutaneous inflammation, aging damage, dyschromia, premature greying hair, or seborrhea.

SEQUENCE LISTING (306 sequences)

SEQ ID NO: 1 - protein, 578 aa, Homo sapiens
MRQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 2 - protein, 552 aa, Homo sapiens
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 3 - protein, 553 aa, Homo sapiens
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYWMAFNVERACQSYFGCVQCISGPLGMYRNSLLQQFLEDWYHQKFLGSKCSFGDDRHLTNRVLSLGYRTKYTARSKCLTETPTKYLRWLNQQTRWSKSYFREWLYNSLWFHKHHLWMTYESVVTGFFPFFLIATVIQLFYRGRIWNILLFLLTVQLVGIIKATYACFLRGNAEMIFMSLYSLLYMSSLLPAKIFAIATINKSGWGTSGRKTIVVNFIGLIPVSIWVAVLLGGLAYTAYCQDLFSETELAFLVSGAILYGCYWVALLMLYLAIIARRCGKKPEQYSLAFAEV

SEQ ID NO: 4 - protein, 281 aa, Homo sapiens
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQPPGKGMAVEDDQVQAAQVRATEAWSVHQRHVSREQ

SEQ ID NO: 5 - protein, 786 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGPQAAVPGVPGTGGVPGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 6 - protein, 730 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 7 - protein, 724 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 8 - protein, 757 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 9 - protein, 710 aa, Homo sapiens
MAGLTAAAPRPGVLLLLLSILHPSRPGGVPGAIPGGVPGGVFYPGAGLGALGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 10 - protein, 685 aa, Homo sapiens
MAGLTAAAPRPGVLLLLLSILHPSRPGGVPGAIPGGVPGGVFYPGAGLGALGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKK

SEQ ID NO: 11 - protein, 676 aa, Homo sapiens
MAGLTAAAPRPGVLLLLLSILHPSRPGGVPGAIPGGVPGGVFYPALGPGGKPLKVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 12 - protein, 658 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAGAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 13 - protein, 791 aa, Homo sapiens
MAGLTAAAPRPGVLLLLLSILHPSRPGGVPGAIPGGVPGGVFYPGAGLGALGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGPQAAVPGVPGTGGVPGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 14 - protein, 759 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGPQAAVPGVPGTGGVPGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 15 - protein, 570 aa, Homo sapiens
MAGLTAAAPRPGVLLLLLSILHPSRPGGVPGAIPGGVPGGVFYPGAGLGALGGGALGPGGKPLKPVPGGLAGAGLGAGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 16 - protein, 692 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 17 - protein, 705 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 18 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPTGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 19 - protein, 1487 aa, Homo sapiens
MIRLGAPQTLVLLTLLVAAVLRCQGQDVQEAGSCVQDGQRYNDKDVWKPEPCRICVCDTGTVLCDDIICEDVKDCLSPEIPFGECCPICPTDLATASGQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 20 - protein, 1418 aa, Homo sapiens
MIRLGAPQTLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 21 - protein, 268 aa, Homo sapiens
MSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 22 - protein, 1466 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 23 - protein, 1163 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 24 - protein, 153 aa, Homo sapiens [sequence omitted]

SEQ ID NO: 25 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 26 - protein, 146 aa, Homo sapiens [sequence omitted]

SEQ ID NO: 27 - protein, 398 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 28 - protein, 296 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQ

SEQ ID NO: 29 - protein, 2351 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 30 - protein, 216 aa, Homo sapiens
MRIQDPGKVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 31 - protein, 1313 aa, Homo sapiens
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKR

SEQ ID NO: 32 - protein, 740 aa, Homo sapiens
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPR

SEQ ID NO: 33 - protein, 573 aa, Homo sapiens
SFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKR

SEQ ID NO: 34 - protein, 684 aa, Homo sapiens
EITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 35 - protein, 461 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 36 - protein, 423 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 37 - protein, 145 aa, Homo sapiens
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTR

SEQ ID NO: 38 - protein, 35 aa, Homo sapiens
AETVFPDVDYVNSTEAETILDNITQSTQSFNDFTR

SEQ ID NO: 39 - protein, 235 aa, Homo sapiens
VVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 40 - protein, 529 aa, Homo sapiens [sequence omitted]

SEQ ID NO: 41 - protein, 377 aa, Homo sapiens
MLLAVLYCLLWSFQTSAGHFPRACVSSKNLMEKECCPPWSGDRSPCGQLSGRGSCQNILLSNAPLGPQFPFTGVDDRESWPSVFYNRTCQCSGNFMGFNCGNCKFGFWGPNCTERRLLVRRNIFDLSAPEKDKFFAYLTLAKHTISSDYVIPIGTYGQMKNGSTPMFNDINIYDLFVWMHYYVSMDALLGGSEIWRDIDFAHEAPAFLPWHRLFLLRWEQEIQKLTGDENFTIPYWDWRDAEKCDICTDEYMGGQHPTNPNLLSPASFFSSWQIVCSRLEEYNSHQSLCNGTPEGPLRRNPGNHDKSRTPRLPSSADVEFCLSLTQYESGSMDKAANFSFRNTLEEMGFLHVGWAGLKLLTSRDPPPWPPKMLGLQA

SEQ ID NO: 42 - protein, 527 aa, Homo sapiens
MSAPKLLSLGCIFFPLLLFQQARAQFPRQCATVEALRSGMCCPDLSPASGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATRKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEERI

SEQ ID NO: 43 - protein, 519 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 44 - protein, 552 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVISNRLLYNATTNILEHVRKEKATKELPSLHVLVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 45 - protein, 217 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 46 - protein, 202 aa, Homo sapiens
MATGSRTSLLLAFGLLCLPWLQEGSAFPTIPLSRLFDNAMLRAHRLHQLAFDTYQEFNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 47 - protein, 179 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQTLMGRLEDGSPRTGQIFKQTYSKFDTNSHNDDALLKNYGLLYCFRKDMDKVETFLRIVQCRSVEGSCGF

SEQ ID NO: 48 - protein, 171 aa, Homo sapiens
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQIFKQTYSKFDTNSHNDDALLKNYGLLYCFRKDMDKVETFLRIVQCRSVEGSCGF

SEQ ID NO: 49 - protein, 177 aa, Homo sapiens
MATGSRTSLLLAFGLLCLPWLQEGSAFPTIPLSRLFDNAMLRAHRLHQLAFDTYQEFNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 50 - protein, 128 aa, Homo sapiens
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 51 - protein, 34 aa, Homo sapiens
MSLRLDTTPSCNSARPLHALQVLLLLSLLLTALA

SEQ ID NO: 52 - protein, 94 aa, Homo sapiens
SSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 53 - protein, 85 aa, Homo sapiens
NLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 54 - protein, 83 aa, Homo sapiens
NLAKGKEESLDSDLYAELRCMCIKTTSGIHPKNIQSLEVIGKGTHCNQVEVIATLKDGRKICLDPDAPRIKKIVQKKLAGDES

SEQ ID NO: 55 - protein, 81 aa, Homo sapiens
NLAKGKEESLDSDLYAELRCMCIKTTSGIHPKNIQSLEVIGKGTHCNQVEVIATLKDGRKICLDPDAPRIKKIVQKKLAGD

SEQ ID NO: 56 - protein, 81 aa, Homo sapiens
GKEESLDSDLYAELRCMCIKTTSGIHPKNIQSLEVIGKGTHCNQVEVIATLKDGRKICLDPDAPRIKKIVQKKLAGDESAD

SEQ ID NO: 57 - protein, 74 aa, Homo sapiens
SDLYAELRCMCIKTTSGIHPKNIQSLEVIGKGTHCNQVEVIATLKDGRKICLDPDAPRIKKIVQKKLAGDESAD

SEQ ID NO: 58 - protein, 73 aa, Homo sapiens
DLYAELRCMCIKTTSGIHPKNIQSLEVIGKGTHCNQVEVIATLKDGRKICLDPDAPRIKKIVQKKLAGDESAD

SEQ ID NO: 59 - protein, 70 aa, Homo sapiens
AELRCMCIKTTSGIHPKNIQSLEVIGKGTHCNQVEVIATLKDGRKICLDPDAPRIKKIVQKKLAGDESAD

SEQ ID NO: 60 - protein, 68 aa, Homo sapiens
AELRCMCIKTTSGIHPKNIQSLEVIGKGTHCNQVEVIATLKDGRKICLDPDAPRIKKIVQKKLAGDES

SEQ ID NO: 61 - protein, 66 aa, Homo sapiens
AELRCMCIKTTSGIHPKNIQSLEVIGKGTHCNQVEVIATLKDGRKICLDPDAPRIKKIVQKKLAGD

SEQ ID NO: 62 - protein, 63 aa, Homo sapiens
AELRCMCIKTTSGIHPKNIQSLEVIGKGTHCNQVEVIATLKDGRKICLDPDAPRIKKIVQKKL

SEQ ID NO: 63 - protein, 390 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 64 - protein, 249 aa, Homo sapiens
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRR

SEQ ID NO: 65 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 66 - protein, 442 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 67 - protein, 282 aa, Homo sapiens
LSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKR

SEQ ID NO: 68 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 69 - protein, 277 aa, Homo sapiens
LSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKR

SEQ ID NO: 70 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 71 - protein, 232 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 72 - protein, 215 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 73 - protein, 209 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 74 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 75 - protein, 174 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 76 - protein, 171 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVCDKPRR

SEQ ID NO: 77 - protein, 191 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 78 - protein, 147 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 79 - protein, 137 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 80 - protein, 371 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 81 - protein, 327 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 82 - protein, 395 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 83 - protein, 412 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 84 - protein, 371 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 85 - protein, 389 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 86 - protein, 354 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 87 - protein, 317 aa, Homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRCDKPRR

SEQ ID NO: 88 - protein, 207 aa, Homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 89 - protein, 188 aa, Homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRCRCRRRSFLRCQGRGLELNPDTCRCRKLRR

SEQ ID NO: 90 - protein, 419 aa, Homo sapiens
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS

SEQ ID NO: 91 - protein, 354 aa, Homo sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 92 - protein, 221 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRHSPGRQSPDMPGDFRADAPSFLPPRRSLPMLFRMEWGCALTGSQSAVWPSSPVPEEIPRMHPGRNGKKQQRKPLREKMKPERCGDAVPRR

SEQ ID NO: 93 - protein, 211 aa, Homo sapiens [sequence omitted]

SEQ ID NO: 94 - protein, 196 aa, Homo sapiens
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 95 - protein, 241 aa, Homo sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 96 - protein, 226 aa, Homo sapiens
MFIMGLGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 97 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 98 - protein, 282 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVLQLRPKTGVRGLHKSLTDVALEHHEECDCVCRGSTGG

SEQ ID NO: 99 - protein, 167 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPSNRGGKIIQLHTS

SEQ ID NO: 100 - protein, 182 aa, Homo sapiens
MPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 101 - protein, 370 aa, Homo sapiens
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 102 - protein, 364 aa, Homo sapiens
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 103 - protein, 1207 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 104 - protein, 1165 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 105 - protein, 1166 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 106 - protein, 53 aa, Homo sapiens
NSDSECPLSHDGYCLHDGVCMYIEALDKYACNCVVGYIGERCQYRDLKWWELR

SEQ ID NO: 107 - protein, 155 aa, Homo sapiens
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 108 - protein, 60 aa, Homo sapiens
MAEGEITTFTALTEKFNLPPGNYKKPKLLYCSNGGHFLRILPDGTVDGTRDRSDQHTDTK

SEQ ID NO: 109 - protein, 288 aa, Homo sapiens
MVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 110 - protein, 210 aa, Homo sapiens
MGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 111 - protein, 155 aa, Homo sapiens [sequence omitted]

SEQ ID NO: 112 - protein, 196 aa, Homo sapiens
MGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 113 - protein, 239 aa, Homo sapiens
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 114 - protein, 206 aa, Homo sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 115 - protein, 118 aa, Homo sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDTLLHR

SEQ ID NO: 116 - protein, 268 aa, Homo sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 117 - protein, 123 aa, Homo sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSQVHR

SEQ ID NO: 118 - protein, 208 aa, Homo sapiens
MALGQKLFITMSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATPSFQEECKFRETLLPNNYNAYESDLYQGTYIALSKYGRVKRGSKVSPIMTVTHFLPRI

SEQ ID NO: 119 - protein, 194 aa, Homo sapiens
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 120 - protein, 233 aa, Homo sapiens
MGSPRSALSCLLLHLLVLCLQAQEGPGRGPALGRELASLFRAGREPQGVSQQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 121 - protein, 204 aa, Homo sapiens
MGSPRSALSCLLLHLLVLCLQAQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 122 - protein, 215 aa, Homo sapiens
MGSPRSALSCLLLHLLVLCLQAQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 123 - protein, 244 aa, Homo sapiens
MGSPRSALSCLLLHLLVLCLQAQEGPGRGPALGRELASLFRAGREPQGVSQQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 124 - protein, 208 aa, Homo sapiens
MAPLGEVGNYFGVQDAVPFGNVPVLPVDSPVLLSDHLGQSEAGGLPRGPAVTDLDHLKGILRRRQLYCRTGFHLEIFPNGTIQGTRKDHSRFGILEFISIAVGLVSIRGVDSGLYLGMNEKGELYGSEKLTQECVFREQFEENWYNTYSSNLYKHVDTGRRYYVALNKDGTPREGTRTKRHQKFTHFLPRPVDPDKVPELYKDILSQS

SEQ ID NO: 125 - protein, 208 aa, Homo sapiens
MWKWILTHCASAFPHLPGCCCCCFLLLFLVSSVPVTCQALGQDMVSPEATNSSSSSFSSPSSAGRHVRSYNHLQGDVRWRKLFSFTKYFLKIEKNGKVSGTKKENCPYSILEITSVEIGVVAVKAINSNYYLAMNKKGKLYGSKEFNNDCKLKERIEENGYNTYASFNWQHNGRQMYVALNGKGAPRRGQKTRRKNTSAHFLPMVVHS

SEQ ID NO: 126 - protein, 225 aa, Homo sapiens
MAALASSLIRQKREVREPGGSRPVSAQRRVCPRGTKSLCQKQLLILLSKVRLCGGRPARPDRGPEPQLKGIVTKLFCRQGFYLQANPDGSIQGTPEDTSSFTHFNLIPVGLRVVTIQSAKLGHYMAMNAEGLLYSSPHFTAECRFKECVFENYYVLYASALYRQRRSGRAWYLGLDKEGQVMKGNRVKKTKAAAHFLPKLLEVAMYQEPSLHSVPEASPSSPPAP

SEQ ID NO: 127 - protein, 243 aa, Homo sapiens
MAAAIASSLIRQKRQARESNSDRVSASKRRSSPSKDGRSLCERHVLGVFSKVRFCSGRKRPVRRRPEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 128 - protein, 181 aa, Homo sapiens
MESKEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 129 - protein, 245 aa, Homo sapiens
MAAAIASSLIRQKRQAREREKSNACKCVSSPSKGKTSCDKNKLNVFSRVKLFGSKKRRRRRPEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 130 - protein, 192 aa, Homo sapiens
MALLRKSYSEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 131 - protein, 255 aa, Homo sapiens
MSGKVTKPKEEKDASKVLDDAPPGTQEYIMLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 132 - protein, 199 aa, Homo sapiens
MSGKVTKPKEEKDASKEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 133 - protein, 226 aa, Homo sapiens
MLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 134 - protein, 247 aa, Homo sapiens
MAAAIASGLIRQKRQAREQHWDRPSASRRRSSPSKNRGLCNGNLVDIFSKVRIFGLKKRRLRRQDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 135 - protein, 252 aa, Homo sapiens
MVKPVPLFRRTDFKLLLCNHKDLFFLRVSKLLDCFSPKSMWFLWNIFSKGTHMLQCLCGKSLKKNKNPTDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 136 - protein, 207 aa, Homo sapiens
MAEVGGVFASLDWDLHGFSSSLGNVPLADSPGFLNERLGQIEGKLQRGSPTDFAHLKGILRRRQLYCRTGFHLEIFPNGTVHGTRHDHSRFGILEFISLAVGLISIRGVDSGLYLGMNERGELYGSKKLTRECVFREQFEENWYNTYASTLYKHSDSERQYYVALNKDGSPREGYRTKRHQKFTHFLPRPVDPSKLPSMSRDLFHYR

SEQ ID NO: 137 - protein, 216 aa, Homo sapiens
MGAARLLPNLTLCLQLLILCCQTQGENHPSPNFNQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 138 - protein, 205 aa, Homo sapiens
MGAARLLPNLTLCLQLLILCCQTQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 139 - protein, 207 aa, Homo sapiens
MYSAPSACTCLCLHFLLLCFQVQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 140 - protein, 216 aa, Homo sapiens
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 141 - protein, 211 aa, Homo sapiens
MAPLAEVGGFLGGLEGLGQQVGSHFLLPPAGERPPLLGERRSAAERSARGGPGAAQLAHLHGILRRRQLYCRTGFHLQILPDGSVQGTRQDHSLFGILEFISVAVGLVSIRGVDSGLYLGMNDKGELYGSEKLTSECIFREQFEENWYNTYSSNIYKHGDTGRRYFVALNKDGTPRDGARSKRHQKFTHFLPRPVDPERVPELYKDLLMYT

SEQ ID NO: 142 - protein, 209 aa, Homo sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 143 - protein, 170 aa, Homo sapiens
MRRRLWLGLAWLLLARAPDAAGTPSASRGPRSYPHLEGDVRWRRLFSSTHFFLRVDPGGRVQGTRWRHGQDSILEIRSVHVGVVVIKAVSSGFYVAMNRRGRLYGSRLYTVDCRFRERIEENGHNTYASQRWRRRGQPMFLALDRRGGPRPGGRTRRYHLSAHFLPVLVS

SEQ ID NO: 144 - protein, 251 aa, Homo sapiens
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 145 - protein, 313 aa, Homo sapiens
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 146 - protein, 270 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAPSGRNLTPAELPAKQREQLLGICDAALCRQVQLLGVRLVVGVGRLAEQRARRALAGLMPEVQVEGLLHPSPRNPQANKGWEAVAKERLNELGLLPLLLK

SEQ ID NO: 147 - protein, 680 aa, Homo sapiens
MEAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHAMPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAPSGRNLTPAELPAKQREQLLGICDAALCRQVQLLGVRLVVGVGRLAEQRARRALAGLMPEVQVEGLLHPSPRNPQANKGWEAVAKERLNELGLLPLLLK

SEQ ID NO: 148 - protein, 410 aa, Homo sapiens
MEAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 149 - protein, 424 aa, Homo sapiens
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 150 - protein, 546 aa, Homo sapiens
MTPLVSRLSRLWAIMRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 151 - protein, 312 aa, Homo sapiens
MCSPQESGMTALSARMLTRSRSLGPGAGPRGCREEPGPLRRREAAAEARKSHSPVKRPRKAQRLRVAYEGSDSEKGEGAEPLKVPVWEPQDWQQQLVNIRAMRNKKDAPVDHLGTEHCYDSSAPPKVRRYQVLLSLMLSSQTKDQVTAGAMQRLRARGLTVDSILQTDDATLGKLIYPVGFWRSKVKYIKQTSAILQQHYGGDIPASVAELVALPGVGPKMAHLAMAVAWGTVSGIAVDTHVHRIANRLRWTKKATKSPEETRAALEEWLPRELWHEINGLLVGFGQQTCLPVHPRCHACLNQALCPAAQGL

SEQ ID NO: 152 - protein, 298 aa, Homo sapiens
MVTPALQMKKPKQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 153 - protein, 390 aa, Homo sapiens
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRENVLRNLADKAFDRPICEALLDQRFFNGIGNYLRAEILYRLKIPPFEKARSVLEALQQHRPSPELTLSQKIRTKLQNPDLLELCHSVPKEVVQLGGKGYGSESGEEDFAAFRAWLRCYGMPGMSSLQDRHGRTIWFQGDPGPLAPKGRKSRKKKSKATQLSPEDRVEDALPPSKAPSRTRRAKRDLPKRTATQRPEGTSLQQDPEAPTVPKKGRRKGRQAASGHCRPRKVKADIPSLEPEGTSAS

SEQ ID NO: 154 - protein, 332 aa, Homo sapiens
MPEGPLVRKFHHLVSPFVGQQVVKTGGSSKKLQPASLQSLWLQDTQVHGKKLFLRFDLDEEMGPPGSSPTPEPPQKEVQKEGAADPKQVGEPSGQKTLDGSSRSAELVPQGEDDSEYLERDAPAGDAGRWLRVSFGLFGSVWVNDFSRAKKANKRGDWRDPSPRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 155 - protein, 605 aa, Homo sapiens
MVEGPGCTLNGEKIRARVLPGQAVTGVRGSALRSLQGRALRLAASTVVVSPQAAALNNDSSQNVLSLFNGYVYSGVETLGKELFMYFGPKALRIHFGMKGFIMINPLEYKYKNGASPVLEVQLTKDLICFFDSSVELRNSMESQQRIRMMKELDVCSPEFSFLRAESEVKKQKGRMLGDVLMDQNVLPGVGNIIKNEALFDSGLHPAVKVCQLTDEQIHHLMKMIRDFSILFYRCRKAGLALSKHYKVYKRPNCGQCHCRITVCRFGDNNRMTYFCPHCQKENPQHVDICKLPTRNTIISWTSSRVDHVMDSVARKSEEHWTCVVCTLINKPSSKACDACLTSRPIDSVLKSEENSTVFSHLMKYPCNTFGKPHTEVKINRKTAFGTTTLVLTDFSNKSSTLERKTKQNQILDEEFQNSPPASVCLNDIQHPSKKTTNDITQPSSKVNISPTISSESKLFSPAHKKPKTAQYSSPELKSCNPGYSNSELQINMTDGPRTLNPDSPRCSKHNRLCILRVVRKDGENKGRQFYACPLPREAQCGFFEWADLSFPFCNHGKRSTMKTVLKIGPNNGKNFFVCPLGKEKQCNFFQWAENGPGIKIIPGC

SEQ ID NO: 156 - protein, 238 aa, Homo sapiens
MLGQPAPLERFASRRPQVLAVRTVCDLVLGKMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVPILIPCHRVVCSSGAVGNYSGGLAVKEWLLAHEGHRLGKPGLGGSSGLAGAWLKGAGATSGSPPAGRN

SEQ ID NO: 157 - protein, 261 aa, Homo sapiens
MDRFLVKGAQGGLLRKQEEQEPTGEEPAVLGGDKESTRKRPRREAPGNGGHSAGPSWRHIRAEGLDCSYTVLFGKAEADEIFQELEKEVEYFTGALARVQVFGKWHSVPRKQATYGDAGLTYTFSGLTLSPKPWIPVLERIRDHVSGVTGQTFNFVLINRYKDGCDHIGEHRDDERELAPGSPIASVSFGACRDFVFRHKDSRGKSPSRRVAVVRLPLAHGSLLMMNHPTNTHWYHSLPVRKKVLAPRVNLTFRKILLTKK

SEQ ID NO: 158 - protein, 286 aa, Homo sapiens
MEEKRRRARVQGAWAAPVKSQAIAQPATTAKSHLHQKPGQTWKNKEHHLSDREFVFKEPQQVVRRAPEPRVIDREGVYEISLSPTGVSRVCLYPGFVDVKEADWILEQLCQDVPWKQRTGIREDITYQQPRLTAWYGELPYTYSRITMEPNPHWHPVLRTLKNRIEENTGHTFNSLLCNLYRNEKDSVDWHSDDEPSLGRCPIIASLSFGATRTFEMRKKPPPEENGDYTYVERVKIPLDHGTLLIMEGATQADWQHRVPKEYHSREPRVNLTFRTVYPDPRGAPW

SEQ ID NO: 159 - protein, 934 aa, Homo sapiens [sequence omitted]

SEQ ID NO: 160 - protein, 1137 aa, Homo sapiens
MSRRKPASGGLAASSSAPARQAVLSRFFQSTGSLKSTSSSTGAADQVDPGAAAAAAAAAAAAPPAPPAPAFPPQLPPHIATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGQSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 161 - protein, 1360 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 162 - protein, 756 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 163 - protein, 862 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPETDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 164 - protein, 936 aa, Homo sapiens
MLRPEISSTSPSAPAVSPSSGETRSPQGPRYNFGLQETPQSRPSVQVVSASTCPGTSGAAGDRSSSSSSLPCPAPNSRPAQGSYFGNKRAYAENTVASNFTFGASSSSARDTNYPQTLKTPLSTGNPQRSGYKSWTPQVGYSASSSSAISAHSPSVIVAVVEGRGLARGEIGMASIDLKNPQIILSQFADNTTYAKVITKLKILSPLEIIMSNTACAVGNSTKLFTLITENFKNVNFTTIQRKYFNETKGLEYIEQLCIAEFSTVLMEVQSKYYCLAAVAALLKYVEFIQNSVYAPKSLKICFQGSEQTAMIDSSSAQNLELLINNQDYRNNHTLFGVLNYTKTPGGSRRLRSNILEPLVDIETINMRLDCVQELLQDEELFFGLQSVISRFLDTEQLLSVLVQIPKQDTVNAAESKITNLIYLKHTLELVDPLKIAMKNCNTPLLRAYYGSLEDKRFGIILEKIKTVINDDARYMKGCLNMRTQKCYAVRSNINEFLDIARRTYTEIVDDIAGMISQLGEKYSLPLRTSFSSARGFFIQMTTDCIALPSDQLPSEFIKISKVKNSYSFTSADLIKMNERCQESLREIYHMTYMIVCKLLSEIYEHIHCLYKLSDTVSMLDMLLSFAHACTLSDYVRPEFTDTLAIKQGWHPILEKISAEKPIANNTYVTEGSNFLIITGPNMSGKSTYLKQIALCQIMAQIGSYVPAEYSSFRIAKQIFTRISTDDDIETNSSTFMKEMKEIAYILHNANDKSLILIDELGRGTNTEEGIGICYAVCEYLLSLKAFTLFATHFLELCHIDALYPNVENMHFEVQHVKNTSRNKEAILYTYKLSKGLTEEKNYGLKAAEVSSLPPSIVLDAKEITTQITRQILQNQRSTPEMERQRAVYHLATRLVQTARNSQLDPDSLRIYLSNLKKKYKEDFPRTEQVPEKTEE

SEQ ID NO: 165 - protein, 834 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLLRLWFTRPTHDLGELSSRLDVIQFFLLPQNLDMAQMLHRLLGHIKNVPLILKRMKLSHTKVSDWQVLYKTVYSALGLRDACRSLPQSIQLFRDIAQEFSDDLHHIASLIGKVVDFEGSLAENRFTVLPNIDPEIDEKKRRLMGLPSFLTEVARKELENLDSRIPSCSVIYIPLIGFLLSIPRLPSMVEASDFEINGLDFMFLSEEKLHYRSARTKELDALLGDLHCEIRDQETLLMYQLQCQVLARAAVLTRVLDLASRLDVLLALASAARDYGYSRPRYSPQVLGVRIQNGRHPLMELCARTFVPNSTECGGDKGRVKVITGPNSSGKSIYLKQVGLITFMALVGSFVPAEEAEIGAVDAIFTRIHSCESISLGLSTFMIDLNQVAKAVNNATAQSLVLIDEFGKGTNTVDGLALLAAVLRHWLARGPTCPHIFVATNFLSLVQLQLLPQGPLVQYLTMETCEDGNDLVFFYQVCEGVAKASHASHTAAQAGLPDKLVARGKEVSDLIRSGKPIKPVKDLLKKNQMENCQTLVDKFMKLDLEDPNLDLNVFMSQEVLPAATSIL

SEQ ID NO: 166 - protein, 1429 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEADSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 167 - protein, 932 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 168 - protein, 169 aa, Homo sapiens
MNTLQGPVSFKDVAVDFTQEEWRQLDPDEKIAYGDVMLENYSHLVSVGYDYHQAKHHHGVEVKEVEQGEEPWIMEGEFPCQHSPEPAKAIKPIDRKSVHQICSGPVVLSLSTAVKELVENSLDAGATNIDLKLKDYGVDLIEVSDNGCGVEEENFEGLTMSPFLPATRR

SEQ ID NO: 169 - protein, 940 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEELSEPVLGDVRESTAFSRSLLPVKPVEIEIETPEQAKTRERSEKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQRKAPAPQRTKAGSKSASRTHRGSHRKDPSLPAASSSSSSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEFQAKHMDQPLPTAIGLYKNHPLYALKRHLLKYEAIYPETAAILGYCRGEAVYSRDCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEQL

SEQ ID NO: 170 - protein, 409 aa, Homo sapiens
MQVTLKTLQQQTFKIDIDPEETVKALKEKIESEKGKDAFPVAGQKLIYAGKILNDDTALKEYKIDEKNFVVVMVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMGIPGDRESQAVVDPPQAASTGAPQSSAVAAAAATTTATTTTTSSGGHPLEFLRNQPQFQQMRQIIQQNPSLLPALLQQIGRENPQLLQQISQHQEHFIQMLNEPVQEAGGQGGGGGGGSGGIAEAGSGHMNYIQVTPQEKEAIERLKALGFPEGLVIQAYFACEKNENLAANFLLQQNFDED

SEQ ID NO: 171 - protein, 172 aa, Homo sapiens
MASNFKKANMASSSQRKRMSPKPELTEEQKQEIREAFDLFDADGTGTIDVKELKVAMRALGFEPKKEEIKKMISEIDKEGTGKMNFGDFLTVMTQKMSEKDTKEEILKAFKLFDDDETGKISFKNLKRVAKELGENLTDEELQEMIDEADRDGDGEVSEQEFLRIMKKTSLY

SEQ ID NO: 172 - protein, 363 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 173 - protein, 273 aa, Homo sapiens
MAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKELRRAVRSSVWKRETIVHQHEYGPEENLEDDMYRKTCTMCGHELTYEKM

SEQ ID NO: 174 - protein, 1140 aa, Homo sapiens [sequence omitted]

SEQ ID NO: 175 - protein, 427 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 176 - protein, 616 aa, Homo sapiens
MVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 177 - protein, 270 aa, Homo sapiens
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 178 - protein, 121 aa, Homo sapiens
MVDMMDLPRSRINAGMLAQFIDKPVCFVGRLEKIHPTGKMFILSDGEGKNGTIELMEPLDEEISGIVEVVGRVTAKATILCTSYVQFKEDSHPFDLGLYNEAVKIIHDFPQFYPLGIVQHD

SEQ ID NO: 179 - protein, 782 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 180 - protein, 760 aa, Homo sapiens
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 181 - protein, 548 aa, Homo sapiens
MATSSEEVLLIVKKVRQKKQDGALYLMAERIAWAPEGKDRFTISHMYADIKCQKISPEGKAKIQLQLVLHAGDTTNFHFSNESTAVKERDAVKDLLQQLLPKFKRKANKELEEKNRMLQEDPVLFQLYKDLVVSQVISAEEFWANRLNVNATDSSSTSNHKQDVGISAAFLADVRPQTDGCNGLRYNLTSDIIESIFRTYPAVKMKYAENVPHNMTEKEFWTRFFQSHYFHRDRLNTGSKDLFAECAKIDEKGLKTMVSLGVKNPLLDLTALEDKPLDEGYGISSVPSASNSKSIKENSNAAIIKRFNHHSAMVLAAGLRKQEAQNEQTSEPSNMDGNSGDADCFQPAVKRAKLQESIEYEDLGKNNSVKTIALNLKKSDRYYHGPTPIQSLQYATSQDIINSFQSIRQEMEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 182 - protein, 395 aa, Homo sapiens
MDEEPERTKRWEGGYERTWEILKEDESGSLKATIEDILFKAKRKRVFEHHGQVRLGMMRHLYVVVDGSRTMEDQDLKPNRLTCTLKLLEYFVEEYFDQNPISQIGIIVTKSKRAEKLTELSGNPRKHITSLKKAVDMTCHGEPSLYNSLSIAMQTLKHMPGHTSREVLIIFSSLTTCDPSNIYDLIKTLKAAKIRVSVIGLSAEVRVCTVLARETGGTYHVILDESHYKELLTHHVSPPPASSSSECSLIRMGFPQHTIASLSDQDAKPSFSMAHLDGNTEPGLTLGGYFCPQCRAKYCELPVECKICGLTLVSAPHLARSYHHLFPLDAFQEIPLEEYNGERFCYGCQGELKDQHVYVCAVCQNVFCVDCDVFVHDSLHCCPGCIHKIPAPSGV

SEQ ID NO: 183 - protein, 308 aa, Homo sapiens
MVSDEDELNLLVIVVDANPIWWGKQALKESQFTLSKCIDAVMVLGNSHLFMNRSNKLAVIASHIQESRFLYPGKNGRLGDFFGDPGNPPEFNPSGSKDGKYELLTSANEVIVEEIKDLMTKSDIKGQHTETLLAGSLAKALCYIHRMNKEVKDNQEMKSRILVIKAAEDSALQYMNFMNVIFAAQKQNILIDACVLDSDSGLLQQACDITGGLYLKVPQMPSLLQYLLWVFLPDQDQRSQLILPPPVHVDYRAACFCHRNLIEIGYVCSVCLSIFCNFSPICTTCETAFKISLPPVLKAKKKKLKVSA

SEQ ID NO: 184 - protein, 462 aa, Homo sapiens
MESTPSRGLNRVHLQCRNLQEFLGGLSPGVLDRLYGHPATCLAVFRELPSLAKNWVMRMLFLEQPLPQAAVALWVKKEFSKAQEESTGLLSGLRIWHTQLLPGGLQGLILNPIFRQNLRIALLGGGKAWSDDTSQLGPDKHARDVPSLDKYAEERWEVVLHFMVGSPSAAVSQDLAQLLSQAGLMKSTEPGEPPCITSAGFQFLLLDTPAQLWYFMLQYLQTAQSRGMDLVEILSFLFQLSFSTLGKDYSVEGMSDSLLNFLQHLREFGLVFQRKRKSRRYYPTRLAINLSSGVSGAGGTVHQPGFIVVETNYRLYAYTESELQIALIALFSEMLYRFPNMVVAQVTRESVQQAIASGITAQQIIHFLRTRAHPVMLKQTPVLPPTITDQIRLWELERDRLRFTEGVLYNQFLSQVDFELLLAHARELGVLVFENSAKRLMVVTPAGHSDVKRFWKRQKHSS

SEQ ID NO: 185 - protein, 71 aa, Homo sapiens
MVNVLKGVLIECDPAMKQFLLYLDESNALGKKFIIQDIDDTHVFVIAELVNVLQERVGELMDQNAFSLTQK

SEQ ID NO: 186 - protein, 346 aa, Homo sapiens
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 187 - protein, 323 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSKHEEEEWTDDDLVESL

SEQ ID NO: 188 - protein, 309 aa, Homo sapiens
MDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGYLNHVRAASPQDLAGGYTSSLACHRALQDAFSGLFWQPS

SEQ ID NO: 189 - protein, 1186 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKRKTQKRGITNTLEESSSLKRKRLSDSKRKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 190 - protein, 297 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 191 - protein, 916 aa, Homo sapiens
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIREKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAEVVSKGKGKK

SEQ ID NO: 192 - protein, 919 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 193 - protein, 396 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 194 - protein, 1493 aa, Homo sapiens
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRFEGLGPTVIVCPTTVMHQWVKEFHTWWPPFRVAILHETGSYTHKKEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 195 - protein, 709 aa, Homo sapiens
MDQKLSKLVEELTTSGEPRLNPEKMKELKKICKSSEEQLSRAYRLLIAQLTQEHAEIRLSAFQIVEELFVRSHQFRMLVVSNFQEFLELTLGTDPAQPLPPPREAAQRLRQATTRAVEGWNEKFGEAYKKLALGYHFLRHNKKVDFQDTNARSLAERKREEEKQKHLDKIYQERASQAEREMQEMSGEIESCLTEVESCFRLLVPFDFDPNPETESLGMASGMSDALRSSCAGQVGPCRSGTPDPRDGEQPCCSRDLPASAGHPRAGGGAQPSQTATGDPSDEDEDSDLEEFVRSHGLGSHKYTLDVELCSEGLKVQENEDNLALIHAARDTLKLIRNKFLPAVCSWIQRFTRVGTHGGCLKRAIDLKAELELVLRKYKELDIEPEGGERRRTEALGDAEEDEDDEDFVEVPEKEGYEPHIPDHLRPEYGLEAAPEKDTVVRCLRTRTRMDEEVSDPTSAAAQLRQLRDHLPPPSSASPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKCPFHGKIVPRDDEGRPLDPEDRAREQRRQLQKQERPEWQDPELMRDVEAATGQDLGSSRYSGKGRGKKRRYPSLTNLKAQADTARARIGRKVFAKAAVRRVVAAMNRMDQKKHEKFSNQFNYALN

SEQ ID NO: 196 - protein, 855 aa, Homo sapiens
MVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEDDVDLELRLARFEQLISRRPLLLNSVLLRQNPHHVHEWHKRVALHQGRPREIINTYTEAVQTVDPFKATGKPHTLWVAFAKFYEDNGQLDDARVILEKATKVNFKQVDDLASVWCQCGELELRHENYDEALRLLRKATALPARRAEYFDGSEPVQNRVYKSLKVWSMLADLEESLGTFQSTKAVYDRILDLRIATPQIVINYAMFLEEHKYFEESFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 197 - protein, 1030 aa, Homo sapiens
MAAAAAVEAAAPMGALWGLVHDFVVGQQEGPADQVAADVKSGNYTVLQVVEALGSSLENPEPRTRARAIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 198 - protein, 380 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 199 - protein, 1017 aa, Homo sapiens
MMSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTPGFSDNAIMLFSPDFTLRNTLKSTSEDSLVKQECIKEVVEKREACHCEEVKMTVASEAKIQLSDSEAKSHSSADDASAWSNIQEAPLQDDSCLNNDIPHSIPLEQGSSCNGPGQTTGHPYYLRSFLVVLKTVLENEDDMLLFDEQEKGIVTKFYQLSATGQKLYVRLFQRKLSWIKMTKLEYEEIALDLTPVIEELTNAGFLQTESELQELSEVLELLSAPELKSLAKTFHLVNPNGQKQQLVDAFLKLAKQRSVCTWGKNKPGIGAVILKRAKALAGQSVRICKGPRAVFSRILLLFSLTDSMEDEDAACGGQGQLSTVLLVNLGRMEFPSYTINRKTHIFQDRDDLIRYAAATHMLSDISSAMANGNWEEAKELAQCAKRDWNRLKNHPSLRCHEDLPLFLRCFTVGWIYTRILSRFVEILQRLHMYEEAVRELESLLSQRIYCPDSRGRWWDRLALNLHQHLKRLEPTIKCITEGLADPEVRTGHRLSLYQRAVRLRESPSCKKFKHLFQQLPEMAVQDVKHVTITGRLCPQRGMCKSVFVMEAGEAADPTTVLCSVEELALAHYRRSGFDQGIHGEGSTFSTLYGLLLWDIIFMDGIPDVFRNACQAFPLDLCTDSFFTSRRPALEARLQLIHDAPEESLRAWVAATWHEQEGRVASLVSWDRFTSLQQAQDLVSCLGGPVLSGVCRHLAADFRHCRGGLPDLVVWNSQSRHFKLVEVKGPNDRLSHKQMIWLAELQKLGAEVEVCHVVAVGAKSQSLS

SEQ ID NO: 200 - protein, 314 aa, Homo sapiens
MGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 201 - protein, 236 aa, Homo sapiens
MSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 202 - protein, 803 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKF

SEQ ID NO: 203 - protein, 342 aa, Homo sapiens
MMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 204 - protein, 396 aa, Homo sapiens
MAFAPMGPEASFFDVLDRHRESLLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 205 - protein, 282 aa, Homo sapiens
MALEAAGGPPEETLSLWKREQARLKAHVVDRDTEAWQRDPAFSGLQRVGGVDVSFVKGDSVRACASLVVLSFPELEVVYEESRMVSLTAPYVSGFLAFREVPFLLELVQQLREKEPGLMPQVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKSLGLPGPPTPRSPKAQRPVACPKGDSGESSALC

SEQ ID NO: 206 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 207 - protein, 807 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVLRPVPGDPAGLHPLHAALQPVLRRHGEQAVCGDSAGRAAPAFGG

SEQ ID NO: 208 - protein, 1069 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 209 - protein, 795 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKDRLTEVIASIIKPQNTYCVRRYAVVQKAAHGHVRKAFKSHVLRPVPGDPAGLHPLHAALQPVLRRHGEQAVCGDSAGRAAPAFGG

SEQ ID NO: 210 - protein, 634 aa, Homo sapiens
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 211 - protein, 538 aa, Homo sapiens
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEDVNSVLV

SEQ ID NO: 212 - protein, 18 aa, Artificial Sequence
  Description of Artificial Sequence: Secretory peptide 1
MKNITFIFFILLASPLYA

SEQ ID NO: 213 - protein, 18 aa, Artificial Sequence
  Description of Artificial Sequence: Secretory peptide 2
MKNITFIFFILLASPLYA

SEQ ID NO: 214 - protein, 21 aa, Artificial Sequence
  Description of Artificial Sequence: Secretory peptide 3
MNKVKCYVLFTALLSSLCAYG

SEQ ID NO: 215 - protein, 21 aa, Artificial Sequence
  Description of Artificial Sequence: Secretory peptide 4
MNKVKCYVLFTALLSSLYAHG

SEQ ID NO: 216 - protein, 21 aa, Artificial Sequence
  Description of Artificial Sequence: Secretory peptide 5
MKKLMLAIFISVLSFPSFSQS

SEQ ID NO: 217 - DNA, 18 bp, Artificial Sequence
  Description of Artificial Sequence: Primer sequence
ccctgcttttgtggggtg

SEQ ID NO: 218 - DNA, 18 bp, Artificial Sequence
  Description of Artificial Sequence: Primer sequence
cgaccccaaaagagggac

SEQ ID NO: 219 - DNA, 20 bp, Artificial Sequence
  Description of Artificial Sequence: Primer sequence
atcgcgtcggaagtgtaatc

SEQ ID NO: 220 - DNA, 22 bp, Artificial Sequence
  Description of Artificial Sequence: Primer sequence
agctcggtggggttctctcatc

SEQ ID NO: 221 - DNA, 23 bp, Artificial Sequence
  Description of Artificial Sequence: Primer sequence
gcttcctcataccactggtcatc

SEQ ID NO: 222 - DNA, 22 bp, Artificial Sequence
  Description of Artificial Sequence: Primer sequence
ggtaccactgccatcttcatta

SEQ ID NO: 223 - DNA, 21 bp, Artificial Sequence
  Description of Artificial Sequence: Primer sequence
caccagcagggaatctgtatc

SEQ ID NO: 224 - DNA, 32 bp, Artificial Sequence
  Description of Artificial Sequence: Primer sequence
aggaaggatccatggaaaatatattagacctg

SEQ ID NO: 225 - DNA, 38 bp, Artificial Sequence
  Description of Artificial Sequence: Primer sequence
ctatgaccatgattacgcgcatgaataacggtcgtatg

SEQ ID NO: 226 - DNA, 43 bp, Artificial Sequence
  Description of Artificial Sequence: Primer sequence
gcctgcaggtcgactttaagttattggtatgactggttttaag

SEQ ID NO: 227 - DNA, 27 bp, Artificial Sequence
  Description of Artificial Sequence: Primer sequence
tccatggatccttcctcctttaattgg

SEQ ID NO: 228 - DNA, 33 bp, Artificial Sequence
  Description of Artificial Sequence: Primer sequence
tgcagttctagacgacacaggctgacgaaatta

SEQ ID NO: 229 - DNA, 32 bp, Artificial Sequence
  Description of Artificial Sequence: Primer sequence
cgtagcgaattccatttccctgccctcccgaa

SEQ ID NO: 230 - DNA, 32 bp, Artificial Sequence
  Description of Artificial Sequence: Primer sequence
ctgactgaattcgcttcccaacggggccgttt

SEQ ID NO: 231 - DNA, 32 bp, Artificial Sequence
  Description of Artificial Sequence: Primer sequence
gactgcgaattcctgaagagccgtcaccgaca

SEQ ID NO: 232 - DNA, 34 bp, Artificial Sequence
  Description of Artificial Sequence: Primer sequence
ggcttctggtctcgagtgttgtggaacgacaaca

SEQ ID NO: 233 - DNA, 34 bp, Artificial Sequence
  Description of Artificial Sequence: Primer sequence
ggcttctggtctcgatggcaccaaccttagagag

SEQ ID NO: 234 - DNA, 34 bp, Artificial Sequence
  Description of Artificial Sequence: Primer sequence
ggcttctggtctcgccatgtccgacacaccgttc

SEQ ID NO: 235 - DNA, 35 bp, Artificial Sequence
  Description of Artificial Sequence: Primer sequence
ggcttctggtctcgggtagagactgggtagagacg

SEQ ID NO: 236 - DNA, 29 bp, Artificial Sequence
  Description of Artificial Sequence: Primer sequence
cgtcaccatatgcactcctccgctctgct

SEQ ID NO: 237 - DNA, 32 bp, Artificial Sequence
  Description of Artificial Sequence: Primer sequence
gtagctggatcctcagttgcggatcttcatgg

SEQ ID NO: 238 - DNA, 30 bp, Artificial Sequence
  Description of Artificial Sequence: Primer sequence
cgatgccatatgaactccgactccgagtgt

SEQ ID NO: 239 - DNA, 32 bp, Artificial Sequence
  Description of Artificial Sequence: Primer sequence
gttcacggatcctcagcgcagctcccaccact

SEQ ID NO: 240 - DNA, 29 bp, Artificial Sequence
  Description of Artificial Sequence: Primer sequence
cgtgaccatatgttcccgaccatcccgct

SEQ ID NO: 241 - DNA, 32 bp, Artificial Sequence
  Description of Artificial Sequence: Primer sequence
gtgactggatcctcagaaaccgcaggagccct

SEQ ID NO: 242 - DNA, 36 bp, Artificial Sequence
  Description of Artificial Sequence: Primer sequence
agtaaacttggtctgacatgaagaagacccatcttg

SEQ ID NO: 243 - DNA, 39 bp, Artificial Sequence
  Description of Artificial Sequence: Primer sequence
tatatatatttattatccgatggaccttgttttggagag

SEQ ID NO: 244 - DNA, 38 bp, Artificial Sequence
  Description of Artificial Sequence: Primer sequence
taaacttggtctgacagtgcgcaccgatgagcggcaga

SEQ ID NO: 245 - DNA, 33 bp, Artificial Sequence
  Description of Artificial Sequence: Primer sequence
ttgcaaacatggcaccaaccttagagagtcatg

SEQ ID NO: 246 - DNA, 33 bp, Artificial Sequence
  Description of Artificial Sequence: Primer sequence
ggttggtgccatgtttgcaaaacgattcaaaac

SEQ ID NO: 247 - DNA, 32 bp, Artificial Sequence
  Description of Artificial Sequence: Primer sequence
aggagtgcatatgataaatagacatggttccg

SEQ ID NO: 248 - DNA, 29 bp, Artificial Sequence
  Description of Artificial Sequence: Primer sequence
ctatttatcatatgcactcctccgctctg

SEQ ID NO: 249 - DNA, 40 bp, Artificial Sequence
  Description of Artificial Sequence: Primer sequence
ttatccgattcatgagactgtcagttgcggatcttcatgg

SEQ ID NO: 250 - DNA, 18 bp, Artificial Sequence
  Description of Artificial Sequence: Primer sequence
gaattcgagctcggtacc

SEQ ID NO: 251 - DNA, 20 bp, Artificial Sequence
  Description of Artificial Sequence: Primer sequence
actggccgtcgttttacaac

SEQ ID NO: 252 - DNA, 38 bp, Artificial Sequence
  Description of Artificial Sequence: Primer sequence
gttgtaaaacgacggccagtgaaggcacccatgagcct

SEQ ID NO: 253 - DNA, 33 bp, Artificial Sequence
  Description of Artificial Sequence: Primer sequence
ttgcaaacataaaggttctccgtttattggttg

SEQ ID NO: 254 - DNA, 33 bp, Artificial Sequence
  Description of Artificial Sequence: Primer sequence
gagaacctttatgtttgcaaaacgattcaaaac

SEQ ID NO: 255 - DNA, 32 bp, Artificial Sequence; identical to SEQ ID NO: 247
  Description of Artificial Sequence: Primer sequence

SEQ ID NO: 256 - DNA, 29 bp, Artificial Sequence
  Description of Artificial Sequence: Primer sequence
ctatttatcatatgcactcctccgctctg

SEQ ID NO: 257 - DNA, 33 bp, Artificial Sequence
  Description of Artificial Sequence: Primer sequence
gggtcttcttcattcagttgcggatcttcatgg

SEQ ID NO: 258 - DNA, 29 bp, Artificial Sequence
  Description of Artificial Sequence: Primer sequence
ccgcaactgaatgaagaagacccatcttg

SEQ ID NO: 259 - DNA, 28 bp, Artificial Sequence
  Description of Artificial Sequence: Primer sequence
tagagactggggaccttgttttggagag

SEQ ID NO: 260 - DNA, 46 bp, Artificial Sequence
  Description of Artificial Sequence: Primer sequence
aacaaggtccccagtctctagaatcggataataaatatatataaac

SEQ ID NO: 261 - DNA, 39 bp, Artificial Sequence
  Description of Artificial Sequence: Primer sequence
cgggtaccgagctcgaattccgattatctagacagctcc

SEQ ID NO: 262 - DNA, 18 bp, Artificial Sequence
  Description of Artificial Sequence: Primer sequence
gaattcgagctcggtacc

SEQ ID NO: 263 - DNA, 20 bp, Artificial Sequence
  Description of Artificial Sequence: Primer sequence
actggccgtcgttttacaac

SEQ ID NO: 264 - DNA, 38 bp, Artificial Sequence
  Description of Artificial Sequence: Primer sequence
gttgtaaaacgacggccagttcgtcaatggcgctggac

SEQ ID NO: 265 - DNA, 32 bp, Artificial Sequence
  Description of Artificial Sequence: Primer sequence
ttgcaaacattaagggatctcctccaaatgag

SEQ ID NO: 266 - DNA, 33 bp, Artificial Sequence
  Description of Artificial Sequence: Primer sequence
agatcccttaatgtttgcaaaacgattcaaaac

SEQ ID NO: 267 - DNA, 32 bp, Artificial Sequence; identical to SEQ ID NO: 247
  Description of Artificial Sequence: Primer sequence

SEQ ID NO: 268 - DNA, 29 bp, Artificial Sequence
  Description of Artificial Sequence: Primer sequence
ctatttatcatatgcactcctccgctctg

SEQ ID NO: 269 - DNA, 30 bp, Artificial Sequence
  Description of Artificial Sequence: Primer sequence
tgacggtcattcagttgcggatcttcatgg

SEQ ID NO: 270 - DNA, 31 bp, Artificial Sequence
  Description of Artificial Sequence: Primer sequence
ccgcaactgaatgaccgtcaaggttggtatc

SEQ ID NO: 271 - DNA, 29 bp, Artificial Sequence
  Description of Artificial Sequence: Primer sequence
tagagactggccataacgaaggtgccgtc

SEQ ID NO: 272 - DNA, 46 bp, Artificial Sequence
  Description of Artificial Sequence: Primer sequence
ttcgttatggccagtctctagaatcggataataaatatatataaac

SEQ ID NO: 273 - DNA, 39 bp, Artificial Sequence; identical to SEQ ID NO: 261
  Description of Artificial Sequence: Primer sequence

SEQ ID NO: 274 - DNA, 1047 bp, Propionibacterium acnes
atggcagcgaccgctgaccgcgaaaaggcccttgccacggccttgcagcagatcgagaagcagcacggcaaaggctctatcatgcgccttggcgagcaggagaccgttaagatcgccgctatccccacgggctcggtggccctcgacgtcgcgttgggtgtcggaggcctcccacgtggcaggatcgtggagatctatggtcccgaatcctctggcaagacgacggtggctttgcacgcaatcgctaatgcccaggctgaaggcggcatctgtgcctttattgacgccgagcacgctctcgacccggaatacgcacgcaaactcggggtcgatacagattccctgctggtgagccagcctgacaatggtgagcaggctctcgagattgctgacaccctcgtccgctcgggtgccttggagctcgtcgttgttgactcggtggccgctctgaccccgaaggctgagatcgagggcgagatgggtgattcccatgttggtttgcaggcccgccttatgagccaggccctgcgcaagatgaccggtgcgttaaatgcggccggtaccactgccatcttcattaatcagctgcgcgagaagatcggtgtcatgtttggctccccggagacaacgacaggtggtcgcgccctcaagttctactcgtccgtgcgcctcgacgtgcggcgtgtcgaaactcttaaagacggatcagagatggtcggtaaccgcactcgtgtcaaggttgccaagaacaaggtcgccccaccttttaagcaggcagagtttgacatcctctacggacagggcatttctcgcgagggaagcctcatcgacatgggcgtagattgcggcatcatcaccaaatccggttcgtggttcagctacaacaatgagcagttgggtcagggtaaggagaacgtccgaaagttcctcaaaggtaacccggatgttgccaatgagattgaggacaagatcctgactcacctcggcctgcgcgaagccgaggttcctgagggtgtcgatccccgaactggcgaggtggaattctga

SEQ ID NO: 275 - DNA, 1047 bp, Propionibacterium acnes
atggcagcgaccgctgaccgcgaaaaggcccttgccacggccttgcagcagatcgagaagcagcacggcaagggctctatcatgcgccttggcgagcaggagaccgttaagatcgccgctatccccacgggctcggtggccctcgacgtcgcgttgggtgtcggaggcctcccacgtggcagaatcgtggagatctatggtcccgaatcctccggcaagacgacggtggctttgcacgcaatcgctaatgcccaggctgaaggcggcatctgtgcctttattgacgccgagcacgctctcgacccggaatacgcacgcaaactcggggtcgatacagattccctgctggtgagccagcctgacaatggtgagcaggctctcgagattgctgacaccctcgtccgctcgggtgccttggagctcatcgttgttgactcggtggccgctctgaccccgaaggctgagatcgagggcgagatgggtgattcccatgttggtttgcaggcccgccttatgagccaggccctgcgcaagatgaccggtgcgttgaatgcggccggtaccactgccatcttcattaatcagctgcgcgagaagatcggtgtcatgtttggctccccggagacaacgacaggtggtcgcgccctcaagttctactcgtccgtgcgcctcgacgtgcggcgtgtcgaaactcttaaagacggatcagagatggtcggtaaccgcactcgtgtcaaggttgccaagaacaaggtcgccccaccttttaagcaggcagagtttgacatcctttacggacagggcatttctcgcgagggaagcctcatcgacatgggcgtagattgcggcatcatcaccaaatccggttcgtggttcagctacaacaatgagcagttgggtcagggtaaggagaacgtccgaaagttcctcagaggtaacccggatgttgccaatgagattgaggacaagatcctgactcaccttggcctgcgcgaagccgaggtccctgaaggtgtcgatccccgaactggcgaggtggaattctga

SEQ ID NO: 276 - DNA, 472 bp, Propionibacterium acnes
gacaacgacaggtggtcgcgccctcaagttctactcgtccgtgcgcctcgacgtgcggcgtgtcgaaactcttaaagacggatcagagatggtcggtaaccgcactcgtgtcaaggttgccaagaacaaggtcgccccaccttttaagcaggcagagtttgacatcctctacggacagggcatttctcgcgagggaagcctcatcgacatgggcgtagattgcggcatcatcaccaaatccggttcgtggttcagctacaacaatgagcagttgggtcagggtaaggagaacgtccgaaagttcctcaaaggtaacccggatgttgccaatgagattgaggacaagatcctgactcacctcggcctgcgcgaagccgaggttcctgagggtgtcgatccccgaactggcgaggtggaattctgagtcgccgacgccaggatccgcagccagagctgactgatgaccagtggt

SEQ ID NO: 277 - DNA, 328 bp, Propionibacterium acnes
taaccgcactcgtgtcaaggttgccaagaacaaggtcgccccaccttttaagcaggcagagtttgacatcctttacggacagggcatttctcgcgagggaagcctcatcgacatgggcgtagattgcggcatcatcaccaaatccggttcgtggttcagctacaacaatgagcagttgggtcagggtaaggagaacgtccgaaagttcctcagaggtaacccggatgttgccaatgagattgaggacaagatcctgactcaccttggcctgcgcgaagccgaggtccctgaaggtgtcgatccccgaactggcgaggtggaattctga

SEQ ID NO: 278 - DNA, 471 bp, Propionibacterium acnes
gacacgacaggtggtcgcgccctcaagttctactcgtccgtgcgcctcgacgtgcggcgtgtcgaaactcttaaagacggatcagagatggtcggtaaccgcactcgtgtcaaggttgccaagaacaaggtcgccccaccttttaagcaggcagagtttgacatcctttacggacagggcatttctcgcgagggaagcctcatcgacatgggcgtagattgcggcatcatcaccaaatccggttcgtggttcagctacaacaatgagcagttaggtcagggtaaggagaacgtccgaaagttcctcagaggtaacccggatgttgccaatgagattgaggacaagatcctgactcaccttggcctgcgcgaagccgaggtccctgaaggtgtcgatccccgaactggcgaggtggaattctgagtcgccgacgccaggatctgcagccagaattgactgatgaccagtggt

SEQ ID NO: 279 - DNA, 472 bp, Propionibacterium acnes; identical to SEQ ID NO: 276

SEQ ID NO: 280 - DNA, 472 bp, Propionibacterium acnes; identical to SEQ ID NO: 276

SEQ ID NO: 281 - DNA, 319 bp, Propionibacterium acnes
gacaacgacaggtggtcgcgccctcaagttctactcgtccgtgcgcctcgacgtgcggcgtgtcgaaactcttaaagacggatcagagatggtcggtaaccgcactcgtgtcaaggttgccaagaacaaggtcgccccaccttttaagcaggcagagtttgacatcctctacggacagggcatttctcgcgagggaagcctcatcgacatgggcgtagattgcggcatcatcaccaaatccggttcgtggttcagctacaacaatgagcagttgggtcagggtaaggagaacgtccgaaagttcctcaaaggtaacccg

SEQ ID NO: 282 - DNA, 319 bp, Propionibacterium acnes; identical to SEQ ID NO: 281

SEQ ID NO: 283 - DNA, 319 bp, Propionibacterium acnes; identical to SEQ ID NO: 281

SEQ ID NO: 284 - DNA, 319 bp, Propionibacterium acnes; identical to SEQ ID NO: 281

SEQ ID NO: 285 - DNA, 319 bp, Propionibacterium acnes; identical to SEQ ID NO: 281

SEQ ID NO: 286 - DNA, 319 bp, Propionibacterium acnes; identical to SEQ ID NO: 281

SEQ ID NO: 287 - DNA, 319 bp, Propionibacterium acnes; identical to SEQ ID NO: 281

SEQ ID NO: 288 - DNA, 319 bp, Propionibacterium acnes; identical to SEQ ID NO: 281

SEQ ID NO: 289 - DNA, 319 bp, Propionibacterium acnes; identical to SEQ ID NO: 281

SEQ ID NO: 290 - DNA, 87 bp, Propionibacterium acnes
cgaatctcggaaagccggtctcagttcggattggggtctgcaactcgacctcatgaagtcggagtcgctagtaatcgcagatcagca

SEQ ID NO: 291 - DNA, 87 bp, Propionibacterium acnes
cgaatctcggaaagccggtctcagttcggattggggtctgcaactcgacctcatgaagttggagtcgctagtaatcgcagatcagca

SEQ ID NO: 292 - DNA, 87 bp, Propionibacterium acnes; identical to SEQ ID NO: 290

SEQ ID NO: 293 - DNA, 87 bp, Propionibacterium acnes; identical to SEQ ID NO: 290

SEQ ID NO: 294 - DNA, 87 bp, Propionibacterium acnes; identical to SEQ ID NO: 291

SEQ ID NO: 295 - DNA, 87 bp, Propionibacterium acnes; identical to SEQ ID NO: 291

SEQ ID NO: 296 - DNA, 87 bp, Propionibacterium acnes; identical to SEQ ID NO: 291

SEQ ID NO: 297 - DNA, 87 bp, Propionibacterium acnes
cgaatctcggaaagccggtctcagttcggattggggtctgcaactcgacctcatgaagttggagtcgctagtaatcgcagatcagcc

SEQ ID NO: 298 - DNA, 87 bp, Propionibacterium acnes; identical to SEQ ID NO: 291

SEQ ID NO: 299 - DNA, 87 bp, Propionibacterium acnes; identical to SEQ ID NO: 291

SEQ ID NO: 300 - DNA, 87 bp, Propionibacterium acnes; identical to SEQ ID NO: 291

SEQ ID NO: 301 - DNA, 87 bp, Propionibacterium acnes; identical to SEQ ID NO: 291

SEQ ID NO: 302 - DNA, 87 bp, Propionibacterium acnes; identical to SEQ ID NO: 290

SEQ ID NO: 303 - DNA, 19 bp, Artificial Sequence
  Synthetic
gaggccaagccctggtatg

SEQ ID NO: 304 - DNA, 19 bp, Artificial Sequence
  Synthetic
cgggccgattgatctcagc

SEQ ID NO: 305 - DNA, 22 bp, Artificial Sequence
  Synthetic
aaggtgaaggtcggagtcaacg

SEQ ID NO: 306 - DNA, 22 bp, Artificial Sequence
  Synthetic
ccttctccatggtggtgaagac

What is claimed is:

1. A pharmaceutical composition formulated for topical or mucosal administration to a mammal, the composition comprising a genetically modified *Propionibacterium acnes* (*P. acnes*) strain comprising a growth arrest or essential gene linked to an inducible promoter, wherein the *P. acnes* strain comprises an endogenous CRISPR array, the growth arrest or essential gene linked to the inducible promoter is integrated into the genome of the *P. acnes* strain, and wherein the *P. acnes* strain is *P. acnes*, type II, ribotype 6.

2. The pharmaceutical composition of claim 1, wherein the growth arrest or essential gene encodes a protein selected from the group consisting of a chromosome replication initiator protein DnaA, FtsA, FtsI, FtsL, FtsK, FtsN, FtsQ, FtsW, FtsZ, ZipA, aroE, atpD, gmk, guaA, lepA, recA, and sodA.

3. The pharmaceutical composition of claim 1, wherein the inducible promoter is inducible by a sugar.

4. The pharmaceutical composition of claim 3, wherein the sugar is lactose or arabinose.

5. The pharmaceutical composition of claim 1, wherein the inducible promoter is inducible by an amino acid.

6. The pharmaceutical composition of claim 1, wherein the inducible promoter is inducible by a synthetic amino acid.

7. The pharmaceutical composition of claim 1, wherein the genetically modified *P. acnes* strain has multiple genetic modifications.

8. The pharmaceutical composition of claim 1, comprising a plurality of genetically modified bacteria.

9. The pharmaceutical composition of claim 1, wherein the genetically modified *P. acnes* strain has a modification in which (1) expression of an endogenous protein is substantially reduced or eliminated; and (2) an inducible promoter that regulates expression of a growth arrest or an essential protein.

10. The pharmaceutical composition of claim 1, wherein the composition comprises a sugar or amino acid, wherein the inducible promoter is induced or stimulated by the presence of the sugar or amino acid.

11. A kit comprising:
the pharmaceutical composition of claim 1, configured in an apparatus for delivery, administration, or application, and
optionally instructions for use.

* * * * *